US012790401B2

(12) United States Patent
Raum et al.

(10) Patent No.: US 12,790,401 B2
(45) Date of Patent: Nov. 10, 2026

(54) ANTIBODY CONSTRUCTS FOR CD70 AND CD3

(71) Applicants: AMGEN RESEARCH (MUNICH) GMBH, Munich (DE); AMGEN INC., Thousand Oaks, CA (US)

(72) Inventors: Tobias Raum, Munich (DE); Claudia Blümel, Munich (DE); Wibke Deisting, Munich (DE); Patrick Hoffmann, Munich (DE); Ralf Lutterbüse, Munich (DE); Elisabeth Nahrwold, Munich (DE); Olivier Nolan-Stevaux, Millbrae, CA (US); Marc Panzer, Munich (DE)

(73) Assignees: AMGEN RESEARCH (MUNICH) GMBH, Munich (DE); AMGEN INC., Thousand Oaks, CA (US)

( * ) Notice: Subject to any disclaimer, the term of this patent is extended or adjusted under 35 U.S.C. 154(b) by 795 days.

(21) Appl. No.: 17/084,088

(22) Filed: Oct. 29, 2020

(65) Prior Publication Data

US 2021/0284748 A1 Sep. 16, 2021

Related U.S. Application Data

(62) Division of application No. 15/225,282, filed on Aug. 1, 2016, now Pat. No. 10,851,170.

(60) Provisional application No. 62/290,886, filed on Feb. 3, 2016, provisional application No. 62/199,935, filed on Jul. 31, 2015.

(51) Int. Cl.
*C07K 16/28* (2006.01)
*A61K 39/00* (2006.01)
*C07K 16/30* (2006.01)

(52) U.S. Cl.
CPC ...... *C07K 16/2875* (2013.01); *C07K 16/2809* (2013.01); *C07K 16/3069* (2013.01); *A61K 2039/505* (2013.01); *C07K 2317/31* (2013.01); *C07K 2317/33* (2013.01); *C07K 2317/56* (2013.01); *C07K 2317/565* (2013.01); *C07K 2317/622* (2013.01); *C07K 2317/64* (2013.01); *C07K 2317/73* (2013.01); *C07K 2317/92* (2013.01); *C07K 2317/94* (2013.01)

(58) Field of Classification Search
CPC ...................... C07K 16/2875; A61K 2039/505
See application file for complete search history.

(56) References Cited

U.S. PATENT DOCUMENTS

| | | | |
|---|---|---|---|
| 3,691,016 | A | 9/1972 | Patel |
| 3,773,919 | A | 11/1973 | Boswell et al. |
| 3,969,287 | A | 7/1976 | Jaworek et al. |
| 4,179,337 | A | 12/1979 | Davis et al. |
| 4,195,128 | A | 3/1980 | Gribnau et al. |
| 4,229,537 | A | 10/1980 | Hodgins et al. |
| 4,247,642 | A | 1/1981 | Hirohara et al. |
| 4,301,144 | A | 11/1981 | Iwashita et al. |
| 4,330,440 | A | 5/1982 | Ayers et al. |
| 4,439,196 | A | 3/1984 | Higuchi |
| 4,447,224 | A | 5/1984 | Decant et al. |
| 4,447,233 | A | 5/1984 | Mayfield |
| 4,475,196 | A | 10/1984 | La Zor |
| 4,485,045 | A | 11/1984 | Regen |
| 4,486,194 | A | 12/1984 | Ferrara |
| 4,487,603 | A | 12/1984 | Harris |
| 4,496,689 | A | 1/1985 | Mitra |
| 4,544,545 | A | 10/1985 | Ryan et al. |
| 4,596,556 | A | 6/1986 | Morrow et al. |
| 4,640,835 | A | 2/1987 | Shimizu et al. |
| 4,670,417 | A | 6/1987 | Iwasaki et al. |
| 4,751,180 | A | 6/1988 | Cousens et al. |
| 4,790,824 | A | 12/1988 | Morrow et al. |
| 4,791,192 | A | 12/1988 | Nakagawa et al. |
| 4,816,397 | A | 3/1989 | Boss et al. |
| 4,816,567 | A | 3/1989 | Cabilly et al. |
| 4,935,233 | A | 6/1990 | Bell et al. |
| 4,941,880 | A | 7/1990 | Burns |
| 4,946,778 | A | 8/1990 | Ladner et al. |
| 5,013,556 | A | 5/1991 | Woodle et al. |
| 5,064,413 | A | 11/1991 | Mckinnon et al. |
| 5,223,409 | A | 6/1993 | Ladner et al. |
| 5,225,539 | A | 7/1993 | Winter |

(Continued)

FOREIGN PATENT DOCUMENTS

| | | | |
|---|---|---|---|
| CL | 2007003649 | A1 | 1/2009 |
| CL | 2016002340 | A1 | 6/2017 |

(Continued)

OTHER PUBLICATIONS

Barrett et al. (Curr. Opin. Pediatr. Feb. 2014; 26 (1): 43-9).*

(Continued)

*Primary Examiner* — Julie Wu

(74) *Attorney, Agent, or Firm* — MARSHALL, GERSTEIN & BORUN LLP

(57) ABSTRACT

The present invention relates to a bispecific antibody construct comprising a first binding domain which binds to human CD70 on the surface of a target cell and a second binding domain which binds to human CD3 on the surface of a T cell. Moreover, the invention provides a polynucleotide encoding the antibody construct, a vector comprising said polynucleotide and a host cell transformed or transfected with said polynucleotide or vector. Furthermore, the invention provides a process for the production of the antibody construct of the invention, a medical use of said antibody construct and a kit comprising said antibody construct.

20 Claims, 9 Drawing Sheets

Figure 1:
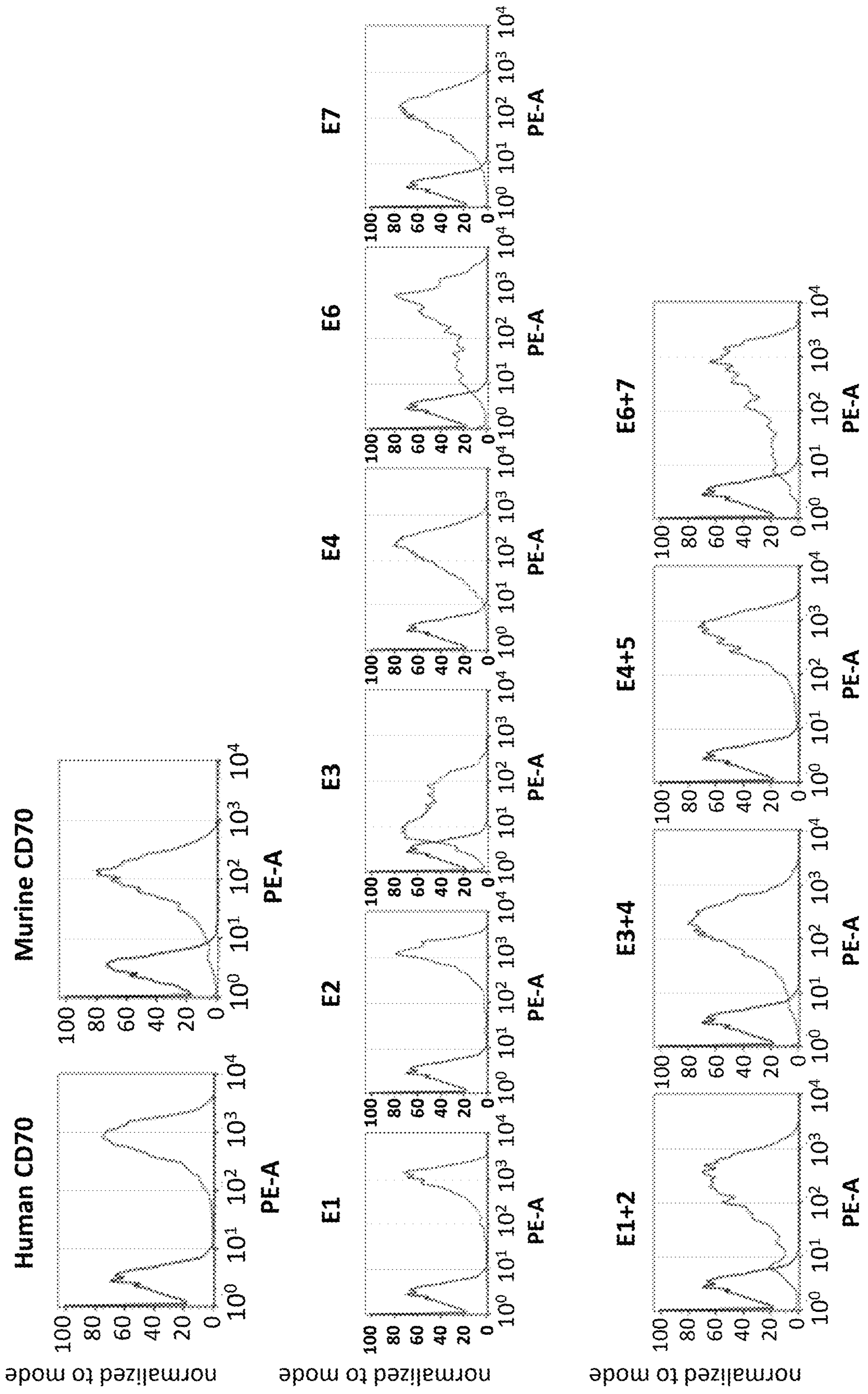

Specification includes a Sequence Listing.

(56) References Cited

U.S. PATENT DOCUMENTS

| | | | |
|---|---|---|---|
| 5,292,658 | A | 3/1994 | Cormier et al. |
| 5,312,335 | A | 5/1994 | Mckinnon et al. |
| 5,383,851 | A | 1/1995 | Mckinnon et al. |
| 5,399,163 | A | 3/1995 | Peterson et al. |
| 5,418,155 | A | 5/1995 | Cormier et al. |
| 5,476,996 | A | 12/1995 | Wilson et al. |
| 5,545,806 | A | 8/1996 | Lonberg et al. |
| 5,545,807 | A | 8/1996 | Surani et al. |
| 5,565,332 | A | 10/1996 | Hoogenboom et al. |
| 5,569,825 | A | 10/1996 | Lonberg et al. |
| 5,585,089 | A | 12/1996 | Queen et al. |
| 5,591,669 | A | 1/1997 | Krimpenfort et al. |
| 5,612,205 | A | 3/1997 | Kay et al. |
| 5,625,126 | A | 4/1997 | Lonberg et al. |
| 5,625,825 | A | 4/1997 | Rostoker et al. |
| 5,633,425 | A | 5/1997 | Lonberg et al. |
| 5,643,763 | A | 7/1997 | Dunn et al. |
| 5,648,260 | A | 7/1997 | Winter et al. |
| 5,661,016 | A | 8/1997 | Lonberg et al. |
| 5,683,888 | A | 11/1997 | Campbell |
| 5,693,761 | A | 12/1997 | Queen et al. |
| 5,693,762 | A | 12/1997 | Queen et al. |
| 5,698,767 | A | 12/1997 | Wilson et al. |
| 5,721,367 | A | 2/1998 | Kay et al. |
| 5,741,668 | A | 4/1998 | Ward et al. |
| 5,770,429 | A | 6/1998 | Lonberg et al. |
| 5,777,079 | A | 7/1998 | Tsien et al. |
| 5,789,215 | A | 8/1998 | Berns et al. |
| 5,789,650 | A | 8/1998 | Lonberg et al. |
| 5,804,387 | A | 9/1998 | Cormack et al. |
| 5,814,318 | A | 9/1998 | Lonberg et al. |
| 5,859,205 | A | 1/1999 | Adair et al. |
| 5,874,299 | A | 2/1999 | Lonberg et al. |
| 5,874,304 | A | 2/1999 | Zolotukhin et al. |
| 5,876,995 | A | 3/1999 | Bryan |
| 5,877,397 | A | 3/1999 | Lonberg et al. |
| 5,925,558 | A | 7/1999 | Tsien et al. |
| 5,939,598 | A | 8/1999 | Kucherlapati et al. |
| 5,958,765 | A | 9/1999 | Brams et al. |
| 5,981,175 | A | 11/1999 | Loring et al. |
| 6,023,010 | A | 2/2000 | Krimpenfort et al. |
| 6,075,181 | A | 6/2000 | Kucherlapati et al. |
| 6,114,598 | A | 9/2000 | Kucherlapati et al. |
| 6,150,584 | A | 11/2000 | Kucherlapati et al. |
| 6,162,963 | A | 12/2000 | Kucherlapati et al. |
| 6,255,458 | B1 | 7/2001 | Lonberg et al. |
| 6,300,064 | B1 | 10/2001 | Knappik et al. |
| 6,407,213 | B1 | 6/2002 | Carter et al. |
| 6,673,986 | B1 | 1/2004 | Kucherlapati et al. |
| 8,987,422 | B2 | 3/2015 | Delaney et al. |
| 9,682,143 | B2 | 6/2017 | Chang et al. |
| 10,851,170 | B2 * | 12/2020 | Raum ................ C07K 16/2875 |
| 2003/0070185 | A1 | 4/2003 | Jakobovits et al. |
| 2005/0076395 | A1 | 4/2005 | Kucherlapati et al. |
| 2010/0150918 | A1 | 6/2010 | Kufer et al. |
| 2010/0150950 | A1 | 6/2010 | Coccia et al. |
| 2014/0099254 | A1 | 4/2014 | Chang et al. |
| 2014/0302037 | A1 | 10/2014 | Borges et al. |
| 2014/0308285 | A1 | 10/2014 | Yan et al. |
| 2015/0166661 | A1 | 6/2015 | Chen et al. |
| 2015/0368343 | A1 | 12/2015 | Xiao et al. |
| 2017/0029502 | A1 | 2/2017 | Raum et al. |
| 2017/0029512 | A1 | 2/2017 | Raum et al. |
| 2017/0037130 | A1 | 2/2017 | Raum et al. |
| 2017/0037149 | A1 | 2/2017 | Raum et al. |
| 2017/0218077 | A1 | 8/2017 | Raum et al. |
| 2017/0218078 | A1 | 8/2017 | Raum et al. |
| 2017/0218079 | A1 | 8/2017 | Raum et al. |
| 2017/0349668 | A1 | 12/2017 | Rattel et al. |

FOREIGN PATENT DOCUMENTS

| | | | |
|---|---|---|---|
| EP | 0036676 | A1 | 9/1981 |
| EP | 0058481 | A1 | 8/1982 |
| EP | 0088046 | A2 | 9/1983 |
| EP | 0133988 | A2 | 3/1985 |
| EP | 0143949 | A1 | 6/1985 |
| EP | 0171496 | A2 | 2/1986 |
| EP | 0173494 | A2 | 3/1986 |
| EP | 0183070 | A2 | 6/1986 |
| EP | 0239400 | A2 | 9/1987 |
| EP | 0244234 | A2 | 11/1987 |
| EP | 0402226 | A1 | 12/1990 |
| EP | 0463151 | A1 | 1/1992 |
| EP | 0546073 | A1 | 6/1993 |
| EP | 0773288 | A2 | 5/1997 |
| EP | 0843961 | A1 | 5/1998 |
| GB | 2177096 | A | 1/1987 |
| JP | 3068180 | B2 | 7/2000 |
| JP | 3068506 | B2 | 7/2000 |
| JP | 3068507 | B2 | 7/2000 |
| WO | 1987/05330 | A1 | 9/1987 |
| WO | 1988/09344 | A1 | 12/1988 |
| WO | 1991/10741 | A1 | 7/1991 |
| WO | 1992/03918 | A1 | 3/1992 |
| WO | 1992/15673 | A1 | 9/1992 |
| WO | 1992/22645 | A1 | 12/1992 |
| WO | 1992/22647 | A1 | 12/1992 |
| WO | 1992/22670 | A1 | 12/1992 |
| WO | 1993/12227 | A1 | 6/1993 |
| WO | 1993/15722 | A1 | 8/1993 |
| WO | 1994/02602 | A1 | 2/1994 |
| WO | 1994/10308 | A1 | 5/1994 |
| WO | 1994/25585 | A1 | 11/1994 |
| WO | 1995/07463 | A1 | 3/1995 |
| WO | 1996/14436 | A1 | 5/1996 |
| WO | 1996/33735 | A1 | 10/1996 |
| WO | 1996/34096 | A1 | 10/1996 |
| WO | 1997/13852 | A1 | 4/1997 |
| WO | 1997/38731 | A1 | 10/1997 |
| WO | 1998/14605 | A1 | 4/1998 |
| WO | 1998/24884 | A1 | 6/1998 |
| WO | 1998/24893 | A2 | 6/1998 |
| WO | 1998/26277 | A2 | 6/1998 |
| WO | 1998/52976 | A1 | 11/1998 |
| WO | 1999/49019 | A2 | 9/1999 |
| WO | 1999/54440 | A1 | 10/1999 |
| WO | 2000/06605 | A2 | 2/2000 |
| WO | 2000/34317 | A2 | 6/2000 |
| WO | 2000/76310 | A1 | 12/2000 |
| WO | 2003/047336 | A2 | 6/2003 |
| WO | 2005/040220 | A1 | 5/2005 |
| WO | 2006/138181 | A2 | 12/2006 |
| WO | 2007/042261 | A2 | 4/2007 |
| WO | 2007/098420 | A2 | 8/2007 |
| WO | 2008/119567 | A2 | 10/2008 |
| WO | 2009/127691 | A1 | 10/2009 |
| WO | 2010/037838 | A2 | 4/2010 |
| WO | 2011/051489 | A2 | 5/2011 |
| WO | 2012/059486 | A1 | 5/2012 |
| WO | 2012/150319 | A1 | 11/2012 |
| WO | 2013/026833 | A1 | 2/2013 |
| WO | 2013/026837 | A1 | 2/2013 |
| WO | 2013/075066 | A2 | 5/2013 |
| WO | 2013/135896 | A1 | 9/2013 |
| WO | 2014/072481 | A1 | 5/2014 |
| WO | 2014/144722 | A2 | 9/2014 |
| WO | 2014/151910 | A1 | 9/2014 |
| WO | 2015/048272 | A1 | 4/2015 |
| WO | 2016/016859 | A1 | 2/2016 |

OTHER PUBLICATIONS

Jacobs et al. (Pharmacol. Ther. Nov. 2015: 155 :1-10).*
Lutterbuese et al. (Proc. Natl. Acad. Sci. USA. Jul. 1, 20103; 107 (28): 12605-10).*
Rattel et al. (Cancer Res. 2010; 70 (8 Suppl.): 2435; pp. 1-2).*
Julian et al. (Sci. Rep. 2017; 7: 45259; pp. 1-13).*
Winkler et al. (J. Immunol. Oct. 15, 2000; 165 (8): 4505-4514).*
Giusti et al. (Proc. Natl. Acad. Sci. USA. May 1987; 84 (9): 2926-2930).*
Chien et al. (Proc. Natl. Acad. Sci. USA. Jul. 1989; 86 (14): 5532-5536).*

(56) References Cited

OTHER PUBLICATIONS

Caldas et al. (Mol. Immunol. May 2003; 39 (15): 941-952).*
Holm et al. (Mol. Immunol. Feb. 2007; 44 (6): 1075-1084).*
Krah et al. (N. Biotechnol. Oct. 25, 2017; 39 (Pt B): 167-173).*
"The Structural basis of antibody-antigen recognition," Sela-Culang et al., Front. Immunol., vol. 4, Cell Biology (Year: 2013).*
"Single amino acid substitution altering antigen-binding specificity," Rudikoff et al, Proc. Natl. Acad. Sci. vol. 79, Immunology (Year: 1982).*
"T cells redirected against CD70 for the immunotherapy of CD70-Positive malignancies," Schaffer et al, Lymphoid Neoplasia, Blood (Year: 2011).*
Aigner et al., T lymphocytes can be effectively recruited for ex vivo and in vivo lysis of AML blasts by a novel CD33/CD3-bispecific BiTE antibody construct, Leukemia, 27(5): 1107-1115 (2013).
Altschul et al., Basic local alignment search tool, J. Mol. Biol., 215:403-10 (1990).
Altschul et al., Gapped BLAST and PSI-BLAST: a new generation of protein database search programs, Nucl. Acids Res., 25(17):3389-402 (1997).
Altschul et al., Local alignment statistics, Methods in Enzymology, 266:460-80 (1996).
Aplin et al., Preparation, properties, and applications of carbohydrate conjugates of proteins and lipids, CRC Crit. Rev. Biochem., 10(4):259-306 (1981).
Arakawa et al., Solvent interactions in pharmaceutical formulations, Pharm. Res., 8(3):285-91 (1991).
Artsaenko et al., The expression of a single-chain Fv antibody against abscisic acid creates a wilty phenotype in transgenic tobacco, The Plant J., 8:745-50 (1995).
Bremer, Targeting of the tumor necrosis factor receptor superfamily for cancer immunotherapy, ISRN Oncol., 176(2):974-25 (2013).
Bruhl et al., Depletion of CCR5-expressing cells with bispecific antibodies and chemokine toxins: a new strategy in the treatment of chronic inflammatory diseases and HIV, J. Immunol., 166:2420-6 (2001).
Caldas et al. Humanization of the anti-CD18 antibody 6.7: an unexpected effect of a framework residue in binding to antigen, Mol. Immunol., 39(15):941-952 (2003).
Carter et al., High level *Escherichia coli* expression and production of a bivalent humanized antibody fragment, Biotechnology, 10:163-7 (1992).
Casset et al., A peptide mimetic of an anti-CD4 monoclonal antibody by rational design, Biochemical and Biophysical Research Communications, 307:198-205 (2003).
Chalfie et al., Green fluorescent protein as a marker for gene expression, Science, 263:802-5 (1994).
Chang et al., Loop-sequence features and stability determinants in antibody variable domains by high-throughput experiments, Structure, 22(1):9-21 (2014).
Cheadle et al., Cloning and expression of the variable regions of mouse myeloma protein MOPC315 in *E. coli*: recovery of active FV fragments, Mol. Immunol., 29:21-30 (1992).
Cheson et al., Report of an international workshop to standardize response criteria for non-Hodgkin's lymphomas, NCI Sponsored International Working Group, J. Clin. Oncol., 17(4):1244-53 (1999).
Chien et al., Significant structural and functional change of an antigen-binding site by a distant amino acid substitution: proposal of a structural mechanism, Proc. Natl. Acad. Sci. USA., 86(14):5532-5536 (1989).
Chothia et al., Canonical structures for the hypervariable regions of immunoglobulins, J. Mol. Biol., 196:901-17 (1987).
Chothia et al., Conformation of immunoglobulin hypervariable regions, Nature, 342:877-83 (1989).
Clackson et al., Making antibody fragments using phage display libraries, Lett. Nature, 352:624-8 (1991).
Cook et al., The human immunoglobulin VH repertoire, Immunol. Today, 16(5):237-42 (1995).
Cunningham et al., High-resolution epitope mapping of hGH-receptor interactions by alanine-scanning mutagenesis, Science, 244:1081-5 (1989).
Dall'acqua et al., Contribution of domain interface residues to the stability of antibody CH3 domain homodimers, Biochemistry, 37:9266-73 (1998).
Devereux et al., A comprehensive set of sequence analysis programs for the VAX, Nucl. Acid. Res., 12:387-95 (1984).
Duskin et al., Relationship of the structure and biological activity of the natural homologues of tunicamycin, J. Biol. Chem., 257:3105-9 (1982).
Edge et al., Deglycosylation of glycoproteins by trifluoromethanesulfonic acid, Anal. Biochem., 118:131-7 (1981).
Eppstein et al., Biological activity of liposome-encapsulated murine interferon y is mediated by a cell membrane receptor, Proc. Natl. Acad. Sci. U.S.A., 82:3688-92 (1985).
Fanslow et al., Structural characteristics of CD40 ligand that determine biological function, Semin. Immunol., 6:267-78 (1994).
Fecker et al., Expression of single-chain antibody fragments (scFv) specific for beet necrotic yellow vein virus coat protein or 25 kDa protein in *Escherichia coli* and Nicotiana benthamiana, Plant Mol. Biol., 32:979-86 (1996).
Feng et al., Progressive sequence alignment as a prerequisite to correct phylogenetic trees, J. Mol. Evol., 35:351-60 (1987).
Gabizon et al., Pharmacokinetics and tissue distribution of doxorubicin encapsulated in stable liposomes with long circulation times, J. National Cancer Inst., 81(19):1484-8 (1989).
Giusti et al., Somatic diversification of S107 from an antiphosphocholine to an anti-DNA autoantibody is due to a single base change in its heavy chain variable region, Proc. Natl. Acad. Sci. USA., 84(9):2926-2930 (1987).
Graham et al., Characteristics of a human cell line transformed by DNA from human adenovirus type 5, J. Gen. Virol., 36:59-74 (1977).
Green et al., Antigen-specific human monoclonal antibodies from mice engineered with human Ig heavy and light chain YACs, Nature Genetics, 7:13-21 (1994).
Green et al., Regulation of B cell development by variable gene complexity in mice reconstituted with human immunoglobulin yeast artificial chromosomes, J. Exp. Med., 188:483-95 (1998).
Grewal et al., CD70 as a therapeutic target in human malignancies, Expert Opin. Ther. Targets., 12(3): 341-51 (2008).
Gussow et al., Humanization of monoclonal antibodies, Methods in Enzymology, 203: 99-121 (1991).
Hakimuddin et al., A chemical method for the deglycosylation of proteins, Arch. Biochem. Biophys., 259:52-7 (1987).
Hawkins et al., Selection of phaae antibodies by bindina affinity, J. Mol. Biol., 254:889-96 (1992).
Heim et al., Engineering green fluorescent protein for improved brightness, longer wavelengths and fluorescence resonating energy transfer, Curr. Biol., 6:178-82 (1996).
Hiatt et al., Production of antibodies in transgenic plants, Nature, 342:76-8 (1989).
Higgins et al., Fast and sensitive multiple sequence alignments on a microcomputer, Cabios, 5:151-3 (1989).
Holliger et al., "Diabodies": small bivalent and bispecific antibody fragments, Proc. Natl. Acad. Sci. U.S.A., 90(14):6444-8 (1993).
Holm et al., Functional mapping and single chain construction of the anti-cytokeratin 8 monoclonal antibody TS1, Mol. Immunol., 44(6):1075-1084 (2007).
Hoppe et al., A parallel three stranded alpha-helical bundle at the nucleation site of collagen triple-helix formation, FEBS Lett., 344:191-5 (1994).
Huston et al., Protein engineering of antibody binding sites: recovery of specific activity in an anti-digoxin single-chain Fv analogue produced in *Escherichia coli*, Proc. Natl. Acad. Sci. U.S.A., 85:5879-83 (1988).
Hwang et al., Hepatic uptake and degradation of unilamellar sphingomyelin/cholesterol liposomes: A kinetic study, Proc. Natl. Acad. Sci. U.S.A., 77:4030-4 (1980).
Ichiki et al., Regulation of the expression of human C epsilon germline transcript. Identification of a novel IL-4 responsive element, J. Immunol., 150:5408-17 (1993).

(56) References Cited

OTHER PUBLICATIONS

International Application No. PCT/EP2016/068294, International Search Report and Written Opinion, mailed Nov. 28, 2016.
International Preliminary Report on Patentability for corresponding International Application No. PCT/EP2016/068294, dated Feb. 15, 2018.
U.S. Appl. No. 07/466,008, Kucherlapati et al.
U.S. Appl. No. 07/574,748, Kay et al.
U.S. Appl. No. 07/575,962, Lonberg et al.
U.S. Appl. No. 07/610,515, Kucherlapati et al.
U.S. Appl. No. 07/904,068, Lonberg et al.
U.S. Appl. No. 07/919,297, Kucherlapati et al.
U.S. Appl. No. 08/112,848, Kucherlapati et al.
U.S. Appl. No. 08/155,301, Lonberg et al.
U.S. Appl. No. 08/161,739, Lonberg et al.
U.S. Appl. No. 08/165,699, Lonberg et al.
U.S. Appl. No. 08/209,741, Kay et al.
U.S. Appl. No. 08/234,145, Kucherlapati et al.
U.S. Appl. No. 08/376,279, Kucherlapati et al.
U.S. Appl. No. 08/430,938, Kucherlapati et al.
U.S. Appl. No. 08/462,837, Kucherlapati et al.
U.S. Appl. No. 08/463,191, Kucherlapati et al.
U.S. Appl. No. 08/464,584, Kucherlapati et al.
U.S. Appl. No. 08/486,853, Kucherlapati et al.
U.S. Appl. No. 08/486,859, Kucherlapati et al.
U.S. Appl. No. 08/759,620, Jakobovits et al.
Teng et al., Construction and testing of mouse-human heteromyelomas for human monoclonal antibody production, Proc. Natl. Acad. Sci. U.S.A., 80:7308-12 (1983).
Thotakura et al., Enzymatic deglycosylation of glycoproteins, Meth. Enzymol., 138:350-9 (1987).
Tomlinson et al., The repertoire of human germline VH sequences reveals about fifty groups of VH segments with different hypervariable loops, J. Mol. Biol., 227:776-98 (1992).
Tomlinson et al., The structural repertoire of the human V kappa domain, Embo J., 14:4628-38 (1995).
Urlaub et al., Isolation of chinese hamster cell mutants deficient in dihydrofolate reductase activity, Proc. Natl. Acad. Sci. U.S.A., 77:4216-20 (1980).
Vajdos et al., Comprehensive functional maps of the antigen-binding site of an anti-ErbB2 antibody obtained with shotgun scanning mutagenesis, J. Mol. Biol., 320(2):415-428 (2002).
Winkler et al., Changing the antigen binding specificity by single point mutations of an anti-p24 (HIV-1) antibody, J. Immunol., 165(8):4505-4514 (2000).
Woo et al., Preclinical Studies in Rats and Squirrel Monkeys for Safety Evaluation of the Bivalent Anti-Human T Cell Immunotoxin, A-dmDT390-bisFV(UCHT1), Cancer Immunol. Immunother., 57:1225-39 (2008).
Wu et al., Humanization of a murine monoclonal antibody by simultaneous optimization of framework and CDR residues, J. Mol. Biol., 294: 151-62 (1999).
Yu et al., Rationalization and Design of the Complementarity Determining Region Sequences in an Antibody-Antigen Recognition Interface, PLoS One, 7(3): e33340, 1-15 (2012).
Jones et al., Replacing the complementarity—determine regions in a human antibody with those from a mouse, Nature, 321:522-5 (1986).
Karlin et al., Applications and statistics for multiple high-scoring segments in molecular sequences, Proc. Natl. Acad. Sci. U.S.A., 90:5873-7 (1993).
Kaufman, Selection and coamplification of heterologous genes in mammalian cells, Meth. Enzymol., 185:537-66 (1990).
Kendrick et al., Physical stabilization of proteins in aqueous solution, Rational design of stable protein formulations: theory and practice, Pharmaceutical Biotechnology, 13:61-84 (2002).
Kipriyanov et al., Bispecific tandem diabody for tumor therapy with improved antigen binding and pharmacokinetics, J. Mol. Biol., 293:41-56 (1999).
Knappe et al., Herpesvirus saimiri-transformed macaque T cells are tolerated and do not cause lymphoma after autoloaous reinfusion, Blood, 95(10):3256-61 (2000).
Kohler et al., Continuous cultures of fused cells secreting antibody of predefined specificity, Nature, 256:495-7 (1975).
Kozbor et al., The production of monoclonal antibodies from human lymphocytes, Immunol. Today, 4(3):72-9 (1983).
Kufer et al., A revival of bispecific antibodies, Trends Biotechnol., 22(5):238-44 (2004).
Kufer et al., Construction and biological activity of a recombinant bispecific single-chain antibody designed for therapy of minimal residual colorectal cancer, Cancer Immunol. Immunother., 45:193-7 (1997).
Landschulz et al., The leucine zipper: a hypothetical structure common to a new class of DNA binding proteins, Research Articles, 240:1759-64 (1988).
Langer et al., Biocompatibility of polymeric delivery systems for macromolecules, J. Biomed. Mater. Res., 15(2):267-77 (1981).
Langer, Controlled release of macromolecules, Chem. Tech., 12:98-105 (1982).
Lazar et al., Engineered antibody Fc variants with enhanced effector function, Proc. Natl. Acad. Sci. USA., 103(11):4005-10 (2006).
Loffler et al., A recombinant bispecific single-chain antibody, CD19 .times. CD3, induces rapid and high lymphoma-directed cytotoxicity by unstimulated T lymphocytes, Blood, 95(6):2098-103 (2000).
Lowman et al., Selecting high-affinity binding proteins by monovalent phage display, Biochemistry, 30:10832-7 (1991).
Maccallum et al., Antibody-antigen interactions: Contact analysis and binding site topography, J. Mol. Biol., 262:732-45 (1996).
Mack et al., A small bispecific antibody construct expressed as a functional single-chain molecule with high tumor cell cytotoxicity, Proc. Natl. Acad. Sci. U.S.A., 92(15):7021-5 (1995).
Mack et al., Biologic properties of a bispecific single-chain antibody directed against 17-1A (EpCAM) and CD3: tumor cell-dependent T cell stimulation and cytotoxic activity, J. Immunol., 158:3965-70 (1997).
Malmborg, BIAcore as a tool in antibody engineering, J. Immunol. Methods, 183:7-13 (1995).
Mariuzza et al., The Structural Basis of Antigen-Antibody Recognition, Annu. Rev. Biophys. Biophys. Chem., 16:139-159 (1987).
Marks et al., By-passing immunization. Human antibodies from V-gene libraries displayed on phage, J. Mol. Biol., 222:581-97 (1991).
Martin et al., Irreversible coupling of immunoglobulin fragments to preformed vesicles. An improved method for liposome targeting, J. Biol. Chem., 257:286-8 (1982).
Martin et al., Structural families in loops of homologous proteins: automatic classification, modelling and application to antibodies, J. Mol. Biol., 263:800-15 (1996).
Mather et al., Culture of testicular cells in hormone-supplemented serum-free medium, Ann. N.Y. Acad. Sci., 383:44-68 (1982).
Mather, Establishment and characterization of two distinct mouse testicular epithelial cell lines, Biol. Reprod., 23:243-51 (1980).
Mendez et al., Functional transplant of megabase human immunoglobulin loci recapitulates human antibody response in mice, Nature Genetics, 15:146-56 (1997).
Morrison et al., Chimeric human antibody molecules: mouse antigen-binding domains with human constant reaion domains, Proc. Natl. Acad. Sci. U.S.A., 81:6851-5 (1984).
Morrison et al., Combinatorial alanine-scanning, Curr. Opin. Chem. Biol., 5(3):302-7 (2001).
Morrison, Transfectomas provide novel chimeric antibodies, Science, 229(4719):1202-7 (1985).
Needleman et al., A general method applicable to the search for similarities in the amino acid sequence of two proteins, J. Mol. Biol., 48:443-53 (1970).
Nolan et al., Fluorescence-activated cell analysis and sorting of viable mammalian cells based on beta-D-galactosidase activity after transduction of *Escherichia coli* lacZ, Proc. Natl. Acad. Sci. U.S.A., 85:2603-7 (1988).
Olsson et al., Human-human monoclonal antibody-producing hybridomas: Technical aspects, Meth. Enzymol., 92:3-16 (1982).

(56) References Cited

OTHER PUBLICATIONS

Owen et al., Synthesis of a functional anti-phytochrome single-chain Fv protein in transgenic tobacco, Biotechnology, 10:790-4 (1992).
Padlan, Anatomy of the antibody molecule, Molec. Immunol., 31(3):169-217 (1993).
Pascalis et al., Grafting of "abbreviated" complementarity-determining regions containing specificity-determining residues essential for ligand contact to engineer a less immunogenic humanized monoclonal antibody, J. Immunol., 169(6):3076-3084 (2002).
Pearson et al., Improved tools for biological sequence comparison, Proc. Natl. Acad. Sci. U.S.A., 85:2444-8 (1988).
Presta, Antibody engineering, Curr. Op. Struct. Biol., 2:593-6 (1992).
Raag et al., Single-chain Fvs, Faseb J., 9(1):73-80 (1995).
Randolph et al., Surfactant-protein interactions, Pharm. Biotechnol., 13:159-75 (2002).
Raum et al., Anti-self antibodies selected from a human IgD heavy chain repertoire: a novel approach to generate therapeutic human antibodies against tumor-associated differentiation antigens, Cancer Immunol. Immunother., 50:141-50 (2001).
Riechmann et al., Reshaping human antibodies for therapy, Nature, 332:323-9 (1988).
Rudikoff et al., Single amino acid substitution altering antigen-binding specificity, Proc. Natl. Acad. Sci. USA, 79(6):1979-1983 (1982).
Schier et al., Efficient in vitro affinity maturation of phage antibodies using BIAcore guided selections, Hum. Antibodies Hybridomas., 7(3):97-105 (1996).
Schlereth et al., T-cell activation and B-cell depletion in chimpanzees treated with a bispecific anti-CD19/anti-CD3 sinale-chain antibody construct, Cancer Immunol. Immunother., 55:503-14 (2006).
Sidman et al., Controlled release of macromolecules and pharmaceuticals from synthetic polypeptides based on glutamic acid, Biopolymers, 2:547-56 (1983).
Smith et al., Comparison of Biosequences, Adv. Appl. Math., 2:482-9 (1981).
Smith, Filamentous fusion phage: novel expression vectors that display cloned antigens on the virion surface, Science, 228:1315-7 (1985).
Stauber et al., Development and applications of enhanced green fluorescent protein mutants, Biotechniques, 24:462-71 (1998).
Takeda et al., Construction of chimaeric processed immunoglobulin genes containing mouse variable and human constant region sequences, Nature, 314:452-4 (1985).

* cited by examiner

ANTIBODY CONSTRUCTS FOR CD70 AND CD3

This application includes a sequence listing submitted electronically as a text file, Filename: 49896B_SubSeqListing.txt; Size: 4,366,169 bytes; Created: Jul. 30, 2024, and is incorporated herein by reference.

The present invention relates to a bispecific antibody construct comprising a first binding domain which binds to human CD70 on the surface of a target cell and a second binding domain which binds to human CD3 on the surface of a T cell. Moreover, the invention provides a polynucleotide encoding the antibody construct, a vector comprising said polynucleotide and a host cell transformed or transfected with said polynucleotide or vector. Furthermore, the invention provides a process for the production of the antibody construct of the invention, a medical use of said antibody construct and a kit comprising said antibody construct.

CD70 (CD27L, TNFSF7) is a type II integral membrane protein whose normal expression is restricted to a subset of activated T and B cells, mature dendritic cells and thymic medullar epithelial cells. The biological functions of CD70 are mediated via binding to the CD27 receptor, which is expressed on lymphocytes and NK cells. CD70 interactions regulate B-cell maturation, T-cell co-stimulation and memory T cell function. Genetic ablation of CD27 in mice, which abrogates CD70 signaling, does not impact the development of B and T cells, but interferes with memory responses to viral re-challenge.

In addition to its highly restricted normal expression, aberrant CD70 expression has been documented in 60% of Non-Hodgkin Lymphoma (NHL), 70% of clear cell renal cell carcinoma (ccRCC), 40% of papillary RCC, as well as 25% of pancreatic adenocarcinoma, 22% of laryngeal/pharyngeal carcinoma, 15% of ovarian carcinoma, and 10% of lung adenocarcinoma and glioblastoma.

Each year, 14,080 people die of metastatic RCC in the U.S. (American Cancer Society: Cancer Facts and Figures. 2015). While all patients are treated with angiogenesis inhibitors (Bevacizumab, Sunitinib, Sorafenib, Axitinib) or mTOR inhibitors (Temsirolimus, Everolimus), the 5-year survival rate for patients with metastatic RCC remains dismally low at 20% (American Cancer Society: Cancer Facts and Figures 2015). A significant unmet medical need remains for this disease, and up to 10,000 patients a year presenting with CD70-expressing metastatic ccRCC could benefit from a CD70-targeted therapy in the U.S.

Diffuse large cell B cell lymphoma (DLBCL) is the largest NHL sub-type with 28,740 new cases per year in the U.S. (American Cancer Society: Cancer Facts and Figures, 2015). 71% of DLBCL tumors express CD70, and while most patients initially respond to standard of care therapy (Rituxan® (rituximab) plus cyclophosphamide, adriamycin, vincristine, prednisone), many relapse or are refractory, and 19,790 patients die of this disease every year (American Cancer Society: Cancer Facts and Figures 2015). Therefore a clear unmet medical need remains for DLCBL, and up to 14,000 patients a year presenting with CD70-expressing DLBCL could benefit from a CD70-targeted therapy in the U.S.

Based on the number of patients dying each year in the U.S. of pancreatic (40,560), laryngeal and pharyngeal (6,300), ovarian (14,180), and lung (158,000) carcinoma (American Cancer Society: Cancer Facts and Figures, 2015), and taking into account the CD70 expression prevalence in these cancer types, up to 30,000 additional patients a year with unmet medical needs presenting with CD70-expressing solid tumors could benefit from a CD70-targeted therapy in the U.S.

As there is still a need for having available further options for the treatment cancer diseases related to the overexpression of CD70, such as the ones discussed herein above, there are provided herewith means and methods for the solution of this problem in the form of a bispecific CD70×CD3 antibody construct.

Thus, in a first aspect, the present invention provides a bispecific antibody construct comprising a first binding domain which binds to human CD70 on the surface of a target cell and a second binding domain which binds to human CD3 on the surface of a T cell.

It must be noted that as used herein, the singular forms “a”, “an”, and “the” include plural references unless the context clearly indicates otherwise. Thus, for example, reference to “a reagent” includes one or more of such different reagents and reference to “the method” includes reference to equivalent steps and methods known to those of ordinary skill in the art that could be modified or substituted for the methods described herein.

Unless otherwise indicated, the term “at least” preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term “and/or” wherever used herein includes the meaning of “and”, “or” and “all or any other combination of the elements connected by said term”.

The term “about” or “approximately” as used herein means within ±20%, preferably within ±15%, more preferably within ±10%, and most preferably within ±5% of a given value or range.

Throughout this specification and the claims which follow, unless the context requires otherwise, the word “comprise”, and variations such as “comprises” and “comprising”, will be understood to imply the inclusion of a stated integer or step or group of integers or steps but not the exclusion of any other integer or step or group of integer or step. When used herein the term “comprising” can be substituted with the term “containing” or “including” or sometimes when used herein with the term “having”.

When used herein “consisting of” excludes any element, step, or ingredient not specified in the claim element. When used herein, “consisting essentially of” does not exclude materials or steps that do not materially affect the basic and novel characteristics of the claim.

In each instance herein any of the terms “comprising”, “consisting essentially of” and “consisting of” may be replaced with either of the other two terms.

The term “antibody construct” refers to a molecule in which the structure and/or function is/are based on the structure and/or function of an antibody, e.g., of a full-length or whole immunoglobulin molecule. An antibody construct is hence capable of binding to its specific target or antigen. Furthermore, an antibody construct according to the invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. The antibodies on which the constructs according to the invention are based include for example monoclonal, recombinant, chimeric, deimmunized, humanized and human antibodies.

Within the definition of "antibody constructs" according to the invention are full-length or whole antibodies also including camelid antibodies and other immunoglobulin antibodies generated by biotechnological or protein engineering methods or processes. These full-length antibodies may be for example monoclonal, recombinant, chimeric, deimmunized, humanized and human antibodies. Also within the definition of "antibody constructs" are fragments of full-length antibodies, such as VH, VHH, VL, (s)dAb, Fv, Fd, Fab, Fab', F(ab')2 or "r IgG" ("half antibody"). Antibody constructs according to the invention may also be modified fragments of antibodies, also called antibody variants, such as scFv, di-scFv or bi(s)-scFv, scFv-Fc, scFv-zipper, scFab, Fab2, Fab3, diabodies, single chain diabodies, tandem diabodies (Tandab's), tandem di-scFv, tandem tri-scFv, "minibodies" exemplified by a structure which is as follows: (VH-VL-CH3)2, (scFv-CH3)2, ((scFv)2-CH3+CH3), ((scFv)2-CH3) or (scFv-CH3-scFv)2, multibodies such as triabodies or tetrabodies, and single domain antibodies such as nanobodies or single variable domain antibodies comprising merely one variable domain, which might be VHH, VH or VL, that specifically bind an antigen or epitope independently of other V regions or domains. Further preferred formats of the antibody constructs according to the invention are cross bodies, maxi bodies, hetero Fc constructs and mono Fc constructs. Examples for those formats will be described herein below.

A binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Additional examples for the format of antibody fragments, antibody variants or binding domains include (1) a Fab fragment, a monovalent fragment having the VL, VH, CL and CH1 domains; (2) a F(ab')2 fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFv-library). Examples for embodiments of antibody constructs according to the invention are e.g. described in WO 00/006605, WO 2005/040220, WO 2008/119567, WO 2010/037838, WO 2013/026837, WO 2013/026833, US 2014/0308285, US 2014/0302037, WO 2014/144722, WO 2014/151910, and WO 2015/048272.

Furthermore, the definition of the term "antibody construct" includes monovalent, bivalent and polyvalent/multivalent constructs and, thus, monospecific constructs, specifically binding to only one antigenic structure, as well as bispecific and polyspecific/multispecific constructs, which specifically bind more than one antigenic structure, e.g. two, three or more, through distinct binding domains. Moreover, the definition of the term "antibody construct" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal. A "recombinant antibody" is an antibody made through the use of recombinant DNA technology or genetic engineering.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the BIAcore™ surface plasmon resonance system can be used to increase the efficiency of phage antibodies which bind to an epitope of a target antigen, such as CD70 or CD3 epsilon (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetical diversity can be increased by chain shuffling. Two or three rounds of mutation and selection using display methods like phage display usually results in antibody fragments with affinities in the low nanomolar range.

A preferred type of an amino acid substitutional variation of the antibody constructs involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e. g. 6-7 sites) are mutated to generate all possible amino acid substitutions at each site. The antibody variants thus generated are displayed in a monovalent fashion from filamentous phage particles as fusions to the gene Ill product of M13 packaged within each particle. The phage-displayed variants are then screened for their biological activity (e. g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human CD70. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. Sci U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct, antibody fragment or antibody variant may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, LA. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs, variants or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or site-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse.

In some embodiments, the antibody constructs of the invention are "isolated" or "substantially pure" antibody constructs. "Isolated" or "substantially pure", when used to describe the antibody constructs disclosed herein, means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target site on the target molecules (antigens), here: CD70 and CD3, respectively. The structure and function of the first binding domain (recognizing CD70), and preferably also the structure and/or function of the second binding domain (recognizing CD3), is/are based on the structure and/or function of an antibody, e.g. of a full-length or whole immunoglobulin molecule. According to the invention, the first binding domain is characterized by the presence of three light chain CDRs (i.e. CDR1, CDR2 and CDR3 of the VL region) and/or three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are in the form of one or more polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids). The term “polypeptide” as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a heteromultimer is an antibody molecule, which, in its naturally occurring form, consists of two identical light polypeptide chains and two identical heavy polypeptide chains. The terms “peptide”, “polypeptide” and “protein” also refer to naturally modified peptides/polypeptides/proteins wherein the modification is effected e.g. by post-translational modifications like glycosylation, acetylation, phosphorylation and the like. A “peptide”, “polypeptide” or “protein” when referred to herein may also be chemically modified such as pegylated. Such modifications are well known in the art and described herein below.

Preferably the binding domain which binds to CD70 and/or the binding domain which binds to CD3 is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the “humanization” of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first XenoMouse mouse strains (see Green et al. Nature Genetics 7:13-21 (1994)). The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse mice is further discussed and delineated in U.S. patent application Ser. No. 07/466,008, Ser. No. 07/610,515, Ser. No. 07/919,297, Ser. No. 07/922,649, Ser. No. 08/031,801, Ser. No. 08/112,848, Ser. No. 08/234,145, Ser. No. 08/376,279, Ser. No. 08/430,938, Ser. No. 08/464,584, Ser. No. 08/464,582, Ser. No. 08/463,191, Ser. No. 08/462,837, Ser. No. 08/486,853, Ser. No. 08/486,857, Ser. No. 08/486,859, Ser. No. 08/462,513, Ser. No. 08/724,752, and Ser. No. 08/759,620; and U.S. Pat. Nos. 6,162,963; 6,150,584; 6,114,598; 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a “minilocus” approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545,807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023,010 to Krimpenfort and Berns, U.S. Pat. Nos. 5,612,205; 5,721,367; and U.S. Pat. No. 5,789,215 to Bems et al., and U.S. Pat. No. 5,643,763 to Choi and Dunn, and GenPharm International U.S. patent application Ser. No. 07/574,748, Ser. No. 07/575,962, Ser. No. 07/810,279, Ser. No. 07/853,408, Ser. No. 07/904,068, Ser. No. 07/990,860, Ser. No. 08/053,131, Ser. No. 08/096,762, Ser. No. 08/155,301, Ser. No. 08/161,739, Ser. No. 08/165,699, Ser. No. 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a human binding domain against CD70 and/or a human binding domain against CD3 in order to vitiate concerns and/or effects of HAMA or HACA response.

The CD70 binding domains of the bispecific antibody constructs that were generated in the context of the present invention were characterized for their epitope specificity, as described in Example 2. The binders were classified into different groups (I, II, III, IIIv, V, VI, VII and VIII—see Table 4), depending on the chimeric CD70 molecule for which a loss of binding was observed in the flow cytometry readout. Hence, according to a preferred embodiment, the first binding domain of the antibody construct of the invention binds to an epitope of CD70 which is comprised within the region denominated E3 (the region as depicted in SEQ ID NO: 745). As described in the following, the binding domain recognizing region E3 may recognize additional CD70 regions.

It is furthermore envisaged that the first binding domain of the antibody construct of the invention binds to an epitope of CD70 which is comprised within a combination of CD70 regions selected from the group consisting of:

a) regions E2, E3, E4 and E6,
b) regions E2, E3 and E4,
c) regions E2, E3 and E6,
d) regions E2 and E3,
e) regions E3, E4 and E6,
f) regions E3 and E4, and
g) regions E3 and E6.

The epitope recognized by the anti-CD70 binding domain may be linear or conformational. The position of the above described regions E2, E3, E4 and E6 within the human CD70 protein as well as their sequence identifiers are described in Example 1.

In a further preferred embodiment, the first binding domain of the antibody construct of the invention does not bind to an epitope comprised within the region denominated E1. It is additionally or alternatively envisaged that the first binding domain of the antibody construct of the invention does not bind to an epitope comprised within the region denominated E7.

The terms "(specifically) binds to", (specifically) recognizes", "is (specifically) directed to", and "(specifically) reacts with" mean in accordance with this invention that a binding domain interacts or specifically interacts with a given epitope or a given target site on the target molecules (antigens), here: CD70 and CD3, respectively.

The term "epitope" refers to a site on an antigen to which a binding domain, an antibody or immunoglobulin, or a derivative, fragment or variant of an antibody or an immunoglobulin, specifically binds. An "epitope" is antigenic and thus the term epitope is sometimes also referred to herein as "antigenic structure" or "antigenic determinant". Thus, the binding domain is an "antigen interaction site". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigenic structure for the first binding domain is comprised within the CD70 protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

A method for epitope mapping is described in the following: When a region (a contiguous amino acid stretch) in the human CD70 protein is exchanged/replaced with its corresponding region of a non-human and non-primate CD70 antigen (e.g., mouse CD70, but others like chicken, rat, hamster, rabbit etc. might also be conceivable), a decrease in the binding of the binding domain is expected to occur, unless the binding domain is cross-reactive for the non-human, non-primate CD70 used. Said decrease is preferably at least 10%, 20%, 30%, 40%, or 50%; more preferably at least 60%, 70%, or 80%, and most preferably 90%, 95% or even 100% in comparison to the binding to the respective region in the human CD70 protein, whereby binding to the respective region in the human CD70 protein is set to be 100%. It is envisaged that the aforementioned human CD70/non-human CD70 chimeras are expressed in CHO cells. It is also envisaged that at the C-terminus of the chimeric molecules a v5 tag is fused, e.g. via a GGGGS linker. The method is described in more detail in Examples 1 and 2.

In an alternative or additional method for epitope mapping, several truncated versions of the human CD70 extracellular domain can be generated in order to determine a specific region that is recognized by a binding domain. In these truncated versions, the different extracellular CD70 domains/sub-domains or regions are stepwise deleted, starting from the C-terminus. It is envisaged that the truncated CD70 versions are expressed in CHO cells. It is also envisaged that at the C-terminus of the truncated molecules a v5 tag is fused, e.g. via a GGGGS linker, which allows verifying their correct expression on the cell surface. A decrease or a loss of binding is expected to occur with those truncated CD70 versions which do not encompass any more the CD70 region that is recognized by the binding domain. The decrease of binding is preferably at least 10%, 20%, 30%, 40%, 50%; more preferably at least 60%, 70%, 80%, and most preferably 90%, 95% or even 100%, whereby binding to the entire human CD70 protein (or its extracellular region or domain) is set to be 100%.

A further method to determine the contribution of a specific residue of a target antigen to the recognition by a antibody construct or binding domain is alanine scanning (see e.g. Morrison K L & Weiss G A. Cur Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time.

The interaction between the binding domain and the epitope or the region comprising the epitope implies that a binding domain exhibits appreciable affinity for the epitope/the region comprising the epitope on a particular protein or antigen (here: CD70 and CD3, respectively) and, generally, does not exhibit significant reactivity with proteins or antigens other than CD70 or CD3. "Appreciable affinity" includes binding with an affinity of about $10^{-6}$ M (KD) or stronger. Preferably, binding is considered specific when the binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than CD70 or CD3. Preferably, a binding domain of the invention does not essentially or substantially bind to proteins or antigens other than CD70 or CD3 (i.e., the first binding domain is not capable of binding to proteins other than CD70 and the second binding domain is not capable of binding to proteins other than CD3).

The term "does not essentially/substantially bind" or "is not capable of binding" means that a binding domain of the present invention does not bind a protein or antigen other than CD70 or CD3, i.e., does not show reactivity of more than 30%, preferably not more than 20%, more preferably not more than 10%, particularly preferably not more than 9%, 8%, 7%, 6% or 5% with proteins or antigens other than CD70 or CD3, whereby binding to CD70 or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

Preferably, the first binding domain of the bispecific antibody construct of the invention comprises a VH region comprising CDR-H1, CDR-H2 and CDR-H3 and a VL region comprising CDR-L1, CDR-L2 and CDR-L3, wherein said CDR-H1, CDR-H2, CDR-H3, CDR-L1, CDR-L2 and CDR-L3 are selected from the group consisting of those depicted in:

| | | | |
|---|---|---|---|
| 1) | SEQ ID NOs: 1-6; | 10) | SEQ: ID NOs: 91-96; |
| 2) | SEQ: ID NOs: 11-16; | 11) | SEQ: ID NOs: 101-106; |
| 3) | SEQ: ID NOs: 21-26; | 12) | SEQ: ID NOs: 111-116; |
| 4) | SEQ: ID NOs: 31-36; | 13) | SEQ: ID NOs: 121-126; |
| 5) | SEQ: ID NOs: 41-46; | 14) | SEQ: ID NOs: 131-136; |
| 6) | SEQ: ID NOs: 51-56; | 15) | SEQ: ID NOs: 141-146; |
| 7) | SEQ: ID NOs: 61-66; | 16) | SEQ: ID NOs: 151-156; |
| 8) | SEQ: ID NOs: 71-76; | 17) | SEQ: ID NOs: 161-166; |
| 9) | SEQ: ID NOs: 81-86; | 18) | SEQ: ID NOs: 171-176; |
| 19) | SEQ: ID NOs: 181-186; | 54) | SEQ: ID NOs: 531-536; |
| 20) | SEQ: ID NOs: 191-196; | 55) | SEQ: ID NOs: 541-546; |
| 21) | SEQ: ID NOs: 201-206; | 56) | SEQ: ID NOs: 551-556; |
| 22) | SEQ: ID NOs: 211-216; | 57) | SEQ: ID NOs: 561-566; |
| 23) | SEQ: ID NOs: 221-226; | 58) | SEQ: ID NOs: 571-576; |
| 24) | SEQ: ID NOs: 231-236; | 59) | SEQ: ID NOs: 581-586; |
| 25) | SEQ: ID NOs: 241-246; | 60) | SEQ: ID NOs: 591-596; |
| 26) | SEQ: ID NOs: 251-256; | 61) | SEQ: ID NOs: 601-606; |
| 27) | SEQ: ID NOs: 261-266; | 62) | SEQ: ID NOs: 611-616; |
| 28) | SEQ: ID NOs: 271-276; | 63) | SEQ: ID NOs: 621-626; |
| 29) | SEQ: ID NOs: 281-286; | 64) | SEQ: ID NOs: 631-636; |
| 30) | SEQ: ID NOs: 291-296; | 65) | SEQ: ID NOs: 641-646; |
| 31) | SEQ: ID NOs: 301-306; | 66) | SEQ: ID NOs: 651-656; |
| 32) | SEQ: ID NOs: 311-316; | 67) | SEQ: ID NOs: 661-666; |
| 33) | SEQ: ID NOs: 321-326; | 68) | SEQ: ID NOs: 671-676; |
| 34) | SEQ: ID NOs: 331-336; | 69) | SEQ: ID NOs: 681-686; |
| 35) | SEQ: ID NOs: 341-346; | 70) | SEQ: ID NOs: 691-696; |
| 36) | SEQ: ID NOs: 351-356; | 71) | SEQ: ID NOs: 701-706; |
| 37) | SEQ: ID NOs: 361-366; | 72) | SEQ: ID NOs: 711-716; |
| 38) | SEQ: ID NOs: 371-376; | 73) | SEQ: ID NOs: 721-726; |
| 39) | SEQ: ID NOs: 381-386; | 74) | SEQ: ID NOs: 731-736; |
| 40) | SEQ: ID NOs: 391-396; | 75) | SEQ: ID NOs: 1044-1049; |
| 41) | SEQ: ID NOs: 401-406; | 76) | SEQ: ID NOs: 1058-1063; |
| 42) | SEQ: ID NOs: 411-416; | 77) | SEQ: ID NOs: 1072-1077; |
| 43) | SEQ: ID NOs: 421-426; | 78) | SEQ: ID NOs: 1086-1091; |
| 44) | SEQ: ID NOs: 431-436; | 79) | SEQ: ID NOs: 1100-1005; |
| 45) | SEQ: ID NOs: 441-446; | 80) | SEQ: ID NOs: 1114-1119; |
| 46) | SEQ: ID NOs: 451-456; | 81) | SEQ: ID NOs: 1128-1133; |
| 47) | SEQ: ID NOs: 461-466; | 82) | SEQ: ID NOs: 1142-1147; |
| 48) | SEQ: ID NOs: 471-476; | 83) | SEQ: ID NOs: 1156-1161; |
| 49) | SEQ: ID NOs: 481-486; | 84) | SEQ: ID NOs: 1170-1175; |
| 50) | SEQ: ID NOs: 491-496; | 85) | SEQ: ID NOs: 1184-1189; |

-continued

| | | | |
|---|---|---|---|
| 51) | SEQ: ID NOs: 501-506; | 86) | SEQ: ID NOs: 1198-1203; |
| 52) | SEQ: ID NOs: 511-516; | 87) | SEQ: ID NOs: 1212-1217; |
| 53) | SEQ: ID NOs: 521-526; | 88) | SEQ: ID NOs: 1226-1231; |
| 89) | SEQ: ID NOs: 1240-1245; | 102) | SEQ: ID NOs: 1422-1427; |
| 90) | SEQ: ID NOs: 1254-1259; | 103) | SEQ: ID NOs: 1436-1441; |
| 91) | SEQ: ID NOs: 1268-1273; | 104) | SEQ: ID NOs: 1450-1455; |
| 92) | SEQ: ID NOs: 1282-1287; | 105) | SEQ: ID NOs: 1464-1469; |
| 93) | SEQ: ID NOs: 1296-1301; | 106) | SEQ: ID NOs: 1478-1483; |
| 94) | SEQ: ID NOs: 1310-1315; | 107) | SEQ: ID NOs: 1492-1497; |
| 95) | SEQ: ID NOs: 1324-1329; | 108) | SEQ: ID NOs: 1506-1511; |
| 96) | SEQ: ID NOs: 1338-1343; | 109) | SEQ: ID NOs: 1520-1525; |
| 97) | SEQ: ID NOs: 1352-1357; | 110) | SEQ: ID NOs: 1534-1539; |
| 98) | SEQ: ID NOs: 1366-1371; | 111) | SEQ: ID NOs: 1548-1553; |
| 99) | SEQ: ID NOs: 1380-1385; | and | |
| 100) | SEQ: ID NOs: 1394-1399; | 112) | SEQ: ID NOs: 1562-1567. |
| 101) | SEQ: ID NOs: 1408-1413; | | |

Of the above defined antibody constructs, the following were found to have particularly beneficial characteristics, as determined in Examples 3-16: The bispecific antibody constructs comprising a first binding domain which binds to human CD70 on the surface of a target cell and a second binding domain which binds to human CD3 on the surface of a T cell, wherein the first binding domain comprises a VH region comprising CDR-H1, CDR-H2 and CDR-H3 and a VL region comprising CDR-L1, CDR-L2 and CDR-L3, wherein said CDR-H1, CDR-H2, CDR-H3, CDR-L1, CDR-L2 and CDR-L3 are selected from the group consisting of those depicted in:

1) SEQ: ID NOs: 1044-1049;
2) SEQ: ID NOs: 1086-1091;
3) SEQ: ID NOs: 1142-1147;
4) SEQ: ID NOs: 1170-1175;
5) SEQ: ID NOs: 1184-1189;
6) SEQ: ID NOs: 1212-1217;
7) SEQ: ID NOs: 1226-1231;

8) SEQ: ID NOs: 1240-1245;
9) SEQ: ID NOs: 1254-1259;
10) SEQ: ID NOs: 1268-1273;
11) SEQ: ID NOs: 1338-1343;
12) SEQ: ID NOs: 1352-1357;
13) SEQ: ID NOs: 1366-1371;
14) SEQ: ID NOs: 1422-1427; and
15) SEQ: ID NOs: 1436-1441.

These constructs are characterized e.g. by a particularly high affinity, high cytotoxic activity (low EC50 values), and beneficial interspecies affinity gap, as well as a high sequence identity of the VH and VL sequences to the human germline, low monomer to dimer conversion, high thermostability, high plasma stability, low turbidity, high protein homogeneity, and a beneficial monomer/dimer potency gap. In this context, it should be noted that these CDR amino acid sequences have a considerably high sequence similarity, which is outlined in the following Tables 1 and 2.

TABLE 1

VH-CDR sequences of a selection of CD70 binders

| | VH-CDR1 | VH-CDR2 | VH-CDR3 | SEQ ID NOs |
|---|---|---|---|---|
| CD70-13D_CC | SYAMS | VISGSGGRPNYAESVKG | VDYSNYLFFDY | 1044-1046 |
| CD70-16D_CC | SYAMS | AISGSGGRTFYAESVEG | HDYSNYPYFDY | 1086-1088 |
| CD70-21D_CC | TYAMS | AISGSGGRTFYAESVEG | HDYSNYPYFDY | 1142-1144 |
| CD70-24D_CC | SYAMS | AISGSGGSTFYAESVKG | HDYSNYPYFDY | 1170-1172 |
| CD70-25D_CC | SYAMS | AISGSGGRTFYAESVEG | HDYSNYPYFDY | 1184-1186 |
| CD70_1-G2D_CC | SYAMS | AISGSGGSTFYAESVQG | HDYSNYPYFDY | 1212-1214 |
| CD70-27D_CC | TYAMS | AISGSGGGTFYAESVKG | HDYSNYPYFDY | 1226-1228 |
| CD70-28D_CC | TYAMS | LISGSGGRTYYAESVKG | HDYSNYPYFDY | 1240-1242 |
| CD70-31D_CC | SYAMS | AISGSGGRAQYAESVQG | HDYSNYPYFDY | 1254-1256 |
| CD70-32D_CC | SYAMS | AISGSGGRTFYAESVEG | HDYSNYPYFDY | 1268-1270 |
| CD70-42D_CC | TYAMS | LISGSGGRTYYAESVKG | HDYSNYPYFDY | 1338-1340 |
| CD70-43D_CC | SYAMS | AISGSGGRTFYAESVEG | HDYSNYPYFDY | 1352-1354 |
| CD70-48D_CC | SYAMS | VISGSGGITDFAESVKG | HDYSNYFFFDY | 1366-1368 |
| CD70-62D_CC | SYSMN | YISSSGGYIYYAESVKG | GDYSNYAYFDY | 1422-1424 |
| CD70-13D_CC | VYAMS | TISGSGGSTFYAESVKG | HDYSNYAYFDY | 1436-1438 |

TABLE 2

VL-CDR sequences of a selection of CD70 binders

| | VL-CDR1 | VL-CDR2 | VL-CDR3 | SEQ ID NOs |
|---|---|---|---|---|
| CD70-13D_CC | RAGQSVRSSYLG | GASSRAT | QQYGYSPPT | 1047-1049 |
| CD70-16D_CC | RASQSIRSSYLA | GASSRAT | QQYGDLPFT | 1089-1091 |
| CD70-21D_CC | RASQSVRSTYLA | GASSRAT | QQYGDLPFT | 1145-1147 |
| CD70-24D_CC | RASQSVRSSYLA | GASSRAT | QQYGDLPFT | 1173-1175 |

TABLE 2-continued

VL-CDR sequences of a selection of CD70 binders

| | VL-CDR1 | VL-CDR2 | VL-CDR3 | SEQ ID NOs |
|---|---|---|---|---|
| CD70-25D_CC | RASQSVRSNYLA | GASSRAT | QQYGDLPFT | 1187-1189 |
| CD70_1-G2D_CC | RASQSVRGNYLA | GASSRAT | QQYGYSPFT | 1215-1217 |
| CD70-27D_CC | RASQSIRSNYLA | GASSRAT | QQYGSSPFT | 1229-1231 |
| CD70-28D_CC | RASQSVRSNYLA | GASNRAT | QQYGISPPT | 1243-1245 |
| CD70-31D_CC | RASQSVSSN-LA | GSSSRAT | QQYGSSPPP | 1257-1259 |
| CD70-32D_CC | RASQGVRSDYLA | GASSRAT | QQYGSTPPT | 1271-1273 |
| CD70-42D_CC | RASQGVRSSYLA | GASSRAT | QQYGSSPPT | 1341-1343 |
| CD70-43D_CC | RASQSVRSNYLA | GASSRAT | QQYGSSPPT | 1355-1357 |
| CD70-48D_CC | RASQGI-SNYLA | AASILQS | QQYFAYPIT | 1369-1371 |
| CD70-62D_CC | RASQGI-SNYLA | AASTLQS | QQYYSTPLT | 1425-1427 |
| CD70-13D_CC | RASQSVRSSYLA | GASSRAT | QQYGDLPFT | 1439-1441 |

This remarkable sequence similarity in the context of the common biological/biochemical characteristics of the antibody constructs allows for drafting a consensus sequence for the six VH and VL CDRs. These consensus sequences are identified in the following. Therefore, it is an object of the present invention to provide a bispecific antibody construct comprising a first binding domain which binds to human CD70 on the surface of a target cell and a second binding domain which binds to human CD3 on the surface of a T cell (and in one embodiment at least to macaque CD3), wherein the first binding domain comprises a VH region comprising CDR-1H1, CDR-H-2 and CDR-H3 and a VL region comprising CDR-1L1, CDR-1L2 and CDR-1L3, wherein said CDR-H1 has the amino acid sequence $X_1YX_2MX_3$ (SEQ ID NO: 1869), wherein $X_1$ is S, Tor V, $X_2$ is A or S, and $X_3$ is S or N;

said CDR-H2 has the amino acid sequence $X_1ISX_2SGGX_3X_4X_5X_6AESVX_7G$ (SEQ ID NO: 1870), wherein $X_1$ is A, Y, V, L, or T, $X_2$ is G or S, $X_3$ is R, Y, S, G or I, $X_4$ is T, I, P, or A, $X_5$ is F, Y, N, Q or D, $X_6$ is Y or F, and $X_7$ is E, K or Q;

said CDR-H3 has the amino acid sequence $X_1DYSNYX_2X_3FDY$ (SEQ ID NO: 1871), wherein $X_1$ is H, G or V, $X_2$ is P, A, L or F, and $X_3$ is Y or F;

said CDR-L1 has the amino acid sequence $RAX_1QX_2X_3X_4X_5X_6X_7LX_8$ (SEQ ID NO: 1872), wherein $X_1$ is S or G, $X_2$ is S or G, $X_3$ is I or V, $X_4$ is R, S or no amino acid, $X_5$ is S or G, Xe is S, N, T or D, $X_7$ is Y or no amino acid, and $X_8$ is A or G;

said CDR-L2 has the amino acid sequence $X_1X_2SX_3X_4X_5X_6$ (SEQ ID NO: 1873), wherein $X_1$ is G or A, $X_2$ is A or S, $X_3$ is S, T, N or I, $X_4$ is R or L, $X_5$ is A or Q, and Xe is T or S; and said CDR-L3 has the amino acid sequence $QQYX_1X_2X_3PX_4X_5$ (SEQ ID NO: 1874), wherein $X_1$ is G, Y or F, $X_2$ is D, S, Y, I or A, $X_3$ is L, T, S or Y, $X_4$ is F, L, P or I, and $X_5$ is T or P.

It is furthermore envisaged that:

said CDR-H1 has the amino acid sequence SYSMN (SEQ ID NO: 1422) or $X_1YAMS$ (SEQ ID NO: 1875), wherein $X_1$ is S, T or V;

said CDR-H2 has an amino acid sequence selected from the group consisting of YISSSGGYIYYAESVKG (SEQ ID NO: 1423), VISGSGGITDFAESVKG (SEQ ID NO: 1367) and $X_1ISGSGGX_2X_3X_4YAESVX_5G$ (SEQ ID NO: 1876), wherein $X_1$ is A, V, L or T, $X_2$ is R, S, or G, $X_3$ is T, P or A, $X_4$ is F, N, Y or Q, and $X_5$ is E, K, or Q;

said CDR-H3 has an amino acid sequence selected from the group consisting of GDYSNYAYFDY (SEQ ID NO: 1424), HDYSNYFFFDY (SEQ ID NO: 1368), and $X_1DYSNYX_2X_3FDY$ (SEQ ID NO: 1877), wherein $X_1$ is H or V, $X_2$ is P, L or A, and $X_3$ is Y or F;

said CDR-L1 has the amino acid sequence RASQGISNYLA (SEQ ID NO: 1425) or $RAX_1QX_2X_3X_4X_5X_6YLX_7$ (SEQ ID NO: 1878), wherein $X_1$ is S or G, $X_2$ is S or G, $X_3$ is I or V, $X_4$ is R or S, $X_5$ is S or G, $X_6$ is S, T, N or D, and $X_7$ is A or G;

said CDR-L2 has the amino acid sequence AASXLQS (SEQ ID NO: 1879), wherein X is T or I, or $GX_1SX_2RAT$ (SEQ ID NO: 1880), wherein $X_1$ is A or S, and $X_2$ is S or N; and said CDR-L3 has an amino acid sequence selected from the group consisting of QQYYSTPLT (SEQ ID NO: 1427), QQYFAYPIT (SEQ ID NO: 1371) and $QQYGX_1X_2PX_3X_4$ (SEQ ID NO: 1881), wherein $X_1$ is D, Y, S or I, $X_2$ is L, S or T, $X_3$ is F or P, and $X_4$ is T or P.

It is furthermore envisaged that:

said CDR-H1 has the amino acid sequence $X_1YAMS$ (SEQ ID NO: 1875), wherein $X_1$ is S, T or V;

said CDR-H2 has the amino acid sequence $X_1ISGSGGX_2X_3X_4YAESVX_5G$ (SEQ ID NO: 1876), wherein $X_1$ is A, V, L or T, $X_2$ is R, S, or G, $X_3$ is T, P or A, $X_4$ is F, N, Y or Q, and $X_5$ is E, K, or Q;

said CDR-H3 has the amino acid sequence $X_1DYSNYX_2X_3FDY$ (SEQ ID NO: 1877), wherein $X_1$ is H or V, $X_2$ is P, L or A, and $X_3$ is Y or F;

said CDR-L1 has the amino acid sequence $RAX_1QX_2X_3X_4X_5X_6YLX_7$ (SEQ ID NO: 1878), wherein $X_1$ is S or G, $X_2$ is S or G, $X_3$ is I or V, $X_4$ is R or S, $X_5$ is S or G, $X_6$ is S, T, N or D, and $X_7$ is A or G;

said CDR-L2 has the amino acid sequence $GX_1SX_2RAT$ (SEQ ID NO: 1880), wherein $X_1$ is A or S, and $X_2$ is S or N; and said CDR-L3 has the amino acid sequence $QQYGX_1X_2PX_3X_4$ (SEQ ID NO: 1881), wherein $X_1$ is D, Y, S or I, $X_2$ is L, S or T, $X_3$ is F or P, and $X_4$ is T or P.

It is furthermore envisaged that:

said CDR-H1 has an amino acid sequence selected from the group consisting of SYAMS (SEQ ID NO: 1044), TYAMS (SEQ ID NO: 1142), VYAMS (SEQ ID NO: 1436) and SYSMN (SEQ ID NO: 1422);

said CDR-H2 has an amino acid sequence selected from the group consisting of AISGSGGRTFYAESVEG (SEQ ID NO: 1087), VISGSGGRPNYAESVKG (SEQ ID NO: 1045), AISGSGGSTFYAESVKG (SEQ ID NO: 1171), AISGSGGSTFYAESVQG (SEQ ID NO: 1213), AISGSGGGTFYAESVKG (SEQ ID NO: 1227), LISGSGGRTYYAESVKG (SEQ ID NO: 1241), AISGSGGRAQYAESVQG (SEQ ID NO: 1255), TISGSGGSTFYAESVKG (SEQ ID NO: 1437), YISSSGGYIYYAESVKG (SEQ ID NO: 1423), and VISGSGGITDFAESVKG (SEQ ID NO: 1367);

said CDR-H3 has an amino acid sequence selected from the group consisting of HDYSNYPYFDY (SEQ ID NO: 1088), VDYSNYLFFDY (SEQ ID NO: 1046), HDYSNYAYFDY (SEQ ID NO: 1438), GDYSNYAYFDY (SEQ ID NO: 1424), and HDYSNYFFFDY (SEQ ID NO: 1368);

said CDR-L1 has an amino acid sequence selected from the group consisting of RASQSIRSSYLA (SEQ ID NO: 1089), RASQSVRSTYLA (SEQ ID NO: 1145), RAGQSVRSSYLG (SEQ ID NO: 1047), RASQSVRSSYLA (SEQ ID NO: 1173), RASQSVRSNYLA (SEQ ID NO: 1187), RASQSVRGNYLA (SEQ ID NO: 1215), RASQSIRSNYLA (SEQ ID NO: 1229), RASQSVSSNLA (SEQ ID NO: 1257), RASQGVRSDYLA (SEQ ID NO: 1271), RASQGVRSSYLA (SEQ ID NO: 1341), and RASQGISNYLA (SEQ ID NO: 1369);

said CDR-L2 has an amino acid sequence selected from the group consisting of GASSRAT (SEQ ID NO: 1048), GASNRAT (SEQ ID NO: 1244), GSSSRAT (SEQ ID NO: 1258), AASTLQS (SEQ ID NO: 1426) and AASILQS (SEQ ID NO: 1370); and said CDR-L3 has an amino acid sequence selected from the group consisting of QQYGDLPFT (SEQ ID NO: 1091); QQYGYSPPT (SEQ ID NO: 1049), QQYGYSPFT (SEQ ID NO: 1217), QQYGSSPFT (SEQ ID NO: 1231), QQYGISPPT (SEQ ID NO: 1245), QQYGSSPPP (SEQ ID NO: 1259), QQYGSTPPT (SEQ ID NO: 1273), QQYGSSPPT (SEQ ID NO: 1343), QQYYSTPLT (SEQ ID NO: 1427), and QQYFAYPIT (SEQ ID NO: 1371).

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding site.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Kabat et al., loc. cit.).

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mol. Biol, 1987, 196: 901-917; and MacCallum et al., J. Mol. Biol, 1996, 262: 732). Still another standard for characterizing the antigen binding site is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding site. H3, for example, can be as short as two amino acid residues or greater than 26 amino acids.

In a classical full-length antibody or immunoglobulin, each light (L) chain is linked to a heavy (H) chain by one covalent disulfide bond, while the two H chains are linked to each other by one or more disulfide bonds depending on the H chain isotype. The CH domain most proximal to VH is usually designated as CH1. The constant ("C") domains are not directly involved in antigen binding, but exhibit various effector functions, such as antibody-dependent, cell-mediated cytotoxicity and complement activation. The Fc region of an antibody is comprised within the heavy chain constant domains and is for example able to interact with cell surface located Fc receptors.

The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, San Diego, CA, 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

A preferred antibody construct according to the invention can also be defined as a bispecific antibody construct comprising a first (preferably human) binding domain which binds to human CD70 on the surface of a target cell and a second binding domain which binds to human CD3 on the surface of a T cell, wherein the first binding domain binds to the same epitope on human CD70 as an antibody selected from the group consisting of CD70-1 to CD70-74 and those as depicted in items 75 to 112 below, i.e., an antibody comprising a VH region comprising CDR-H1, CDR-H2 and CDR-H3 and a VL region comprising CDR-L1, CDR-L2 and CDR-L3, wherein said CDR-H1, CDR-H2, CDR-H3, CDR-L1, CDR-L2 and CDR-L3 are selected from the group consisting of those depicted in:

| | | | |
|---|---|---|---|
| 1) | SEQ ID NOs: 1-6; | 13) | SEQ: ID NOs: 121-126; |
| 2) | SEQ: ID NOs: 11-16; | 14) | SEQ: ID NOs: 131-136; |
| 3) | SEQ: ID NOs: 21-26; | 15) | SEQ: ID NOs: 141-146; |
| 4) | SEQ: ID NOs: 31-36; | 16) | SEQ: ID NOs: 151-156; |
| 5) | SEQ: ID NOs: 41-46; | 17) | SEQ: ID NOs: 161-166; |
| 6) | SEQ: ID NOs: 51-56; | 18) | SEQ: ID NOs: 171-176; |
| 7) | SEQ: ID NOs: 61-66; | 19) | SEQ: ID NOs: 181-186; |
| 8) | SEQ: ID NOs: 71-76; | 20) | SEQ: ID NOs: 191-196; |
| 9) | SEQ: ID NOs: 81-86; | 21) | SEQ: ID NOs: 201-206; |
| 10) | SEQ: ID NOs: 91-96; | 22) | SEQ: ID NOs: 211-216; |
| 11) | SEQ: ID NOs: 101-106; | 23) | SEQ: ID NOs: 221-226; |
| 12) | SEQ: ID NOs: 111-116; | 24) | SEQ: ID NOs: 231-236; |
| 25) | SEQ: ID NOs: 241-246; | 60) | SEQ: ID NOs: 591-596; |
| 26) | SEQ: ID NOs: 251-256; | 61) | SEQ: ID NOs: 601-606; |
| 27) | SEQ: ID NOs: 261-266; | 62) | SEQ: ID NOs: 611-616; |
| 28) | SEQ: ID NOs: 271-276; | 63) | SEQ: ID NOs: 621-626; |
| 29) | SEQ: ID NOs: 281-286; | 64) | SEQ: ID NOs: 631-636; |
| 30) | SEQ: ID NOs: 291-296; | 65) | SEQ: ID NOs: 641-646; |
| 31) | SEQ: ID NOs: 301-306; | 66) | SEQ: ID NOs: 651-656; |
| 32) | SEQ: ID NOs: 311-316; | 67) | SEQ: ID NOs: 661-666; |
| 33) | SEQ: ID NOs: 321-326; | 68) | SEQ: ID NOs: 671-676; |
| 34) | SEQ: ID NOs: 331-336; | 69) | SEQ: ID NOs: 681-686; |
| 35) | SEQ: ID NOs: 341-346; | 70) | SEQ: ID NOs: 691-696; |
| 36) | SEQ: ID NOs: 351-356; | 71) | SEQ: ID NOs: 701-706; |
| 37) | SEQ: ID NOs: 361-366; | 72) | SEQ: ID NOs: 711-716; |
| 38) | SEQ: ID NOs: 371-376; | 73) | SEQ: ID NOs: 721-726; |
| 39) | SEQ: ID NOs: 381-386; | 74) | SEQ: ID NOs: 731-736; |
| 40) | SEQ: ID NOs: 391-396; | 75) | SEQ: ID NOs: 1044-1049; |
| 41) | SEQ: ID NOs: 401-406; | 76) | SEQ: ID NOs: 1058-1063; |
| 42) | SEQ: ID NOs: 411-416; | 77) | SEQ: ID NOs: 1072-1077; |
| 43) | SEQ: ID NOs: 421-426; | 78) | SEQ: ID NOs: 1086-1091; |
| 44) | SEQ: ID NOs: 431-436; | 79) | SEQ: ID NOs: 1100-1005; |
| 45) | SEQ: ID NOs: 441-446; | 80) | SEQ: ID NOs: 1114-1119; |
| 46) | SEQ: ID NOs: 451-456; | 81) | SEQ: ID NOs: 1128-1133; |
| 47) | SEQ: ID NOs: 461-466; | 82) | SEQ: ID NOs: 1142-1147; |
| 48) | SEQ: ID NOs: 471-476; | 83) | SEQ: ID NOs: 1156-1161; |
| 49) | SEQ: ID NOs: 481-486; | 84) | SEQ: ID NOs: 1170-1175; |
| 50) | SEQ: ID NOs: 491-496; | 85) | SEQ: ID NOs: 1184-1189; |
| 51) | SEQ: ID NOs: 501-506; | 86) | SEQ: ID NOs: 1198-1203; |
| 52) | SEQ: ID NOs: 511-516; | 87) | SEQ: ID NOs: 1212-1217; |
| 53) | SEQ: ID NOs: 521-526; | 88) | SEQ: ID NOs: 1226-1231; |
| 54) | SEQ: ID NOs: 531-536; | 89) | SEQ: ID NOs: 1240-1245; |
| 55) | SEQ: ID NOs: 541-546; | 90) | SEQ: ID NOs: 1254-1259; |
| 56) | SEQ: ID NOs: 551-556; | 91) | SEQ: ID NOs: 1268-1273; |
| 57) | SEQ: ID NOs: 561-566; | 92) | SEQ: ID NOs: 1282-1287; |
| 58) | SEQ: ID NOs: 571-576; | 93) | SEQ: ID NOs: 1296-1301; |
| 59) | SEQ: ID NOs: 581-586; | 94) | SEQ: ID NOs: 1310-1315; |
| 95) | SEQ: ID NOs: 1324-1329; | | |
| 96) | SEQ: ID NOs: 1338-1343; | | |
| 97) | SEQ: ID NOs: 1352-1357; | | |
| 98) | SEQ: ID NOs: 1366-1371; | | |
| 99) | SEQ: ID NOs: 1380-1385; | | |
| 100) | SEQ: ID NOs: 1394-1399; | | |
| 101) | SEQ: ID NOs: 1408-1413; | | |
| 102) | SEQ: ID NOs: 1422-1427; | | |
| 103) | SEQ: ID NOs: 1436-1441; | | |
| 104) | SEQ: ID NOs: 1450-1455; | | |
| 105) | SEQ: ID NOs: 1464-1469; | | |
| 106) | SEQ: ID NOs: 1478-1483; | | |
| 107) | SEQ: ID NOs: 1492-1497; | | |
| 108) | SEQ: ID NOs: 1506-1511; | | |
| 109) | SEQ: ID NOs: 1520-1525; | | |
| 110) | SEQ: ID NOs: 1534-1539; | | |
| 111) and | SEQ: ID NOs: 1548-1553; | | |
| 112) | SEQ: ID NOs: 1562-1567. | | |

Whether or not an antibody construct binds to the same epitope of CD70 as another given antibody construct can be measured e.g. by epitope mapping with chimeric or truncated target molecules, e.g. as described herein above and in Example 2.

A preferred antibody construct according to the invention can also be defined as a bispecific antibody construct comprising a first (preferably human) binding domain which binds to human CD70 on the surface of a target cell and a second binding domain which binds to human CD3 on the surface of a T cell, wherein the first binding domain competes for binding with an antibody selected from the group consisting of CD70-1 to CD70-74 and those as depicted in items 75 to 112 above, i.e., an antibody comprising a VH region comprising CDR-H1, CDR-H2 and CDR-H3 and a VL region comprising CDR-L1, CDR-L2 and CDR-L3 selected from the group consisting of those described in items 1) to 112) above.

Whether or not an antibody construct competes for binding with another given antibody construct can be measured in a competition assay such as a competitive ELISA or a cell-based competition assay. Avidin-coupled microparticles (beads) can also be used. Similar to an avidin-coated ELISA plate, when reacted with a biotinylated protein, each of these beads can be used as a substrate on which an assay can be performed. Antigen is coated onto a bead and then precoated with the first antibody. The second antibody is added and any additional binding is determined. Read-out occurs via flow cytometry. See FIG. 2.

In one embodiment, the first binding domain of the antibody construct of the invention comprises a VH region selected from the group consisting of those depicted in SEQ ID NO: 7, SEQ ID NO: 17, SEQ ID NO: 27, SEQ ID NO: 37, SEQ ID NO: 47, SEQ ID NO: 57, SEQ ID NO: 67, SEQ ID NO: 77, SEQ ID NO: 87, SEQ ID NO: 97, SEQ ID NO: 107, SEQ ID NO: 117, SEQ ID NO: 127, SEQ ID NO: 137, SEQ ID NO: 147, SEQ ID NO: 157, SEQ ID NO: 167, SEQ ID NO: 177, SEQ ID NO: 187, SEQ ID NO: 197, SEQ ID NO: 207, SEQ ID NO: 217, SEQ ID NO: 227, SEQ ID NO: 237, SEQ ID NO: 247, SEQ ID NO: 257, SEQ ID NO: 267, SEQ ID NO: 277, SEQ ID NO: 287, SEQ ID NO: 297, SEQ ID NO: 307, SEQ ID NO: 317, SEQ ID NO: 327, SEQ ID NO: 337, SEQ ID NO: 347, SEQ ID NO: 357, SEQ ID NO: 367, SEQ ID NO: 377, SEQ ID NO: 387, SEQ ID NO: 397, SEQ ID NO: 407, SEQ ID NO: 417, SEQ ID NO: 427, SEQ ID NO: 437, SEQ ID NO: 447, SEQ ID NO: 457, SEQ ID NO: 467, SEQ ID NO: 477, SEQ ID NO: 487, SEQ ID NO: 497, SEQ ID NO: 507, SEQ ID NO: 517, SEQ ID NO: 527, SEQ ID NO: 537, SEQ ID NO: 547, SEQ ID NO: 557, SEQ ID NO: 567, SEQ ID NO: 577, SEQ ID NO: 587, SEQ ID NO: 597, SEQ ID NO: 607, SEQ ID NO: 617, SEQ ID NO: 627, SEQ ID NO: 637, SEQ ID NO: 647, SEQ ID NO: 657, SEQ ID NO: 667, SEQ ID NO: 677, SEQ ID NO: 687, SEQ ID NO: 697, SEQ ID NO: 707, SEQ ID NO: 717, SEQ ID NO: 727, SEQ ID NO: 737, SEQ ID NO: 920, SEQ ID NO: 924, SEQ ID NO: 928, SEQ ID NO: 932, SEQ ID NO: 936, SEQ ID NO: 940, SEQ ID NO: 944, SEQ ID NO: 948, SEQ ID NO: 952, SEQ ID NO: 956, SEQ ID NO: 960, SEQ ID NO: 964, SEQ ID NO: 968, SEQ ID NO: 972, SEQ ID NO: 976, SEQ ID NO: 980, SEQ ID NO: 984, SEQ ID NO: 988, SEQ ID NO: 992, SEQ ID NO: 996, SEQ ID NO: 1000, SEQ ID NO: 1004, SEQ ID NO: 1008, SEQ ID NO: 1012, SEQ ID NO: 1016, SEQ ID NO: 1020, SEQ ID NO: 1024, SEQ ID NO: 1028, SEQ ID NO: 1032, SEQ ID NO: 1036, SEQ ID NO: 1040, SEQ ID NO: 1050, SEQ ID NO: 1054, SEQ ID NO: 1064, SEQ ID NO: 1068, SEQ ID NO: 1078, SEQ ID NO: 1082, SEQ ID NO: 1092, SEQ ID NO: 1096, SEQ ID NO: 1106, SEQ ID NO: 1110, SEQ ID NO: 1120, SEQ ID NO: 1124, SEQ ID NO: 1134, SEQ ID NO: 1138, SEQ ID NO: 1148, SEQ ID NO: 1152, SEQ ID NO: 1162, SEQ ID NO: 1166, SEQ ID NO: 1176, SEQ ID NO: 1180, SEQ ID NO: 1190, SEQ ID NO: 1194, SEQ ID NO: 1204, SEQ ID NO: 1208, SEQ ID NO: 1218, SEQ ID NO: 1222, SEQ ID NO: 1232, SEQ ID NO: 1236, SEQ ID NO: 1246, SEQ ID NO: 1250, SEQ ID NO: 1260, SEQ ID NO: 1264, SEQ ID NO: 1274, SEQ ID NO: 1278, SEQ ID NO: 1288, SEQ ID NO: 1292, SEQ ID NO: 1302, SEQ ID NO: 1306, SEQ ID NO: 1316, SEQ ID NO: 1320, SEQ ID NO: 1330, SEQ ID NO: 1334, SEQ ID NO: 1344, SEQ ID NO: 1348, SEQ ID NO: 1358, SEQ ID NO: 1362, SEQ ID NO: 1372, SEQ ID NO: 1376, SEQ ID NO: 1386, SEQ ID NO: 1390, SEQ ID NO: 1400, SEQ ID NO: 1404, SEQ ID NO: 1414, SEQ ID NO: 1418, SEQ ID NO: 1428, SEQ ID NO: 1432, SEQ ID NO: 1442, SEQ ID NO: 1446, SEQ ID NO: 1456, SEQ ID NO: 1460, SEQ ID NO: 1470, SEQ ID NO: 1474, SEQ ID NO: 1484, SEQ ID NO: 1488, SEQ ID NO: 1498, SEQ ID NO: 1502, SEQ ID NO: 1512, SEQ ID NO: 1516, SEQ ID NO: 1526, SEQ ID NO: 1530, SEQ ID NO: 1540, SEQ ID NO: 1544, SEQ ID NO: 1554, SEQ ID NO: 1558, SEQ ID NO: 1568, and SEQ ID NO: 1572.

Preferred is when the first binding domain of the antibody construct of the invention comprises a VH region selected from the group consisting of those depicted in SEQ ID NO: 1050, SEQ ID NO: 1092, SEQ ID NO: 1148, SEQ ID NO: 1176, SEQ ID NO: 1190, SEQ ID NO: 1218, SEQ ID NO: 1232, SEQ ID NO: 1246, SEQ ID NO: 1260, SEQ ID NO: 1274, SEQ ID NO: 1344, SEQ ID NO: 1358, SEQ ID NO: 1372, SEQ ID NO: 1428, and SEQ ID NO: 1442.

In a further embodiment, the first binding domain of the antibody construct of the invention comprises a VL region selected from the group consisting of those depicted in SEQ ID NO: 8, SEQ ID NO: 18, SEQ ID NO: 28, SEQ ID NO: 38, SEQ ID NO: 48, SEQ ID NO: 58, SEQ ID NO: 68, SEQ ID NO: 78, SEQ ID NO: 88, SEQ ID NO: 98, SEQ ID NO: 108, SEQ ID NO: 118, SEQ ID NO: 128, SEQ ID NO: 138, SEQ ID NO: 148, SEQ ID NO: 158, SEQ ID NO: 168, SEQ ID NO: 178, SEQ ID NO: 188, SEQ ID NO: 198, SEQ ID NO: 208, SEQ ID NO: 218, SEQ ID NO: 228, SEQ ID NO: 238, SEQ ID NO: 248, SEQ ID NO: 258, SEQ ID NO: 268, SEQ ID NO: 278, SEQ ID NO: 288, SEQ ID NO: 298, SEQ ID NO: 308, SEQ ID NO: 318, SEQ ID NO: 328, SEQ ID NO: 338, SEQ ID NO: 348, SEQ ID NO: 358, SEQ ID NO: 368, SEQ ID NO: 378, SEQ ID NO: 388, SEQ ID NO: 398, SEQ ID NO: 408, SEQ ID NO: 418, SEQ ID NO: 428, SEQ ID NO: 438, SEQ ID NO: 448, SEQ ID NO: 458, SEQ ID NO: 468, SEQ ID NO: 478, SEQ ID NO: 488, SEQ ID NO: 498, SEQ ID NO: 508, SEQ ID NO: 518, SEQ ID NO: 528, SEQ ID NO: 538, SEQ ID NO: 548, SEQ ID NO: 558, SEQ ID NO: 568, SEQ ID NO: 578, SEQ ID NO: 588, SEQ ID NO: 598, SEQ ID NO: 608, SEQ ID NO: 618, SEQ ID NO: 628, SEQ ID NO: 638, SEQ ID NO: 648, SEQ ID NO: 658, SEQ ID NO: 668, SEQ ID NO: 678, SEQ ID NO: 688, SEQ ID NO: 698, SEQ ID NO: 708, SEQ ID NO: 718, SEQ ID NO: 728, SEQ ID NO: 738, SEQ ID NO: 921, SEQ ID NO: 925, SEQ ID NO: 929, SEQ ID NO: 933, SEQ ID NO: 937, SEQ ID NO: 941, SEQ ID NO: 945, SEQ ID NO: 949, SEQ ID NO: 953, SEQ ID NO: 957, SEQ ID NO: 961, SEQ ID NO: 965, SEQ ID NO: 969, SEQ ID NO: 973, SEQ ID NO: 977, SEQ ID NO: 981, SEQ ID NO: 985, SEQ ID NO: 989, SEQ ID NO: 993, SEQ ID NO: 997, SEQ ID NO: 1001, SEQ ID NO: 1005, SEQ ID NO: 1009, SEQ ID NO: 1013, SEQ ID NO: 1017, SEQ ID NO: 1021, SEQ ID NO: 1025, SEQ ID NO: 1029, SEQ ID NO: 1033, SEQ ID NO: 1037, SEQ ID NO: 1041, SEQ ID NO: 1051, SEQ ID NO: 1055, SEQ ID NO: 1065, SEQ ID NO: 1069, SEQ ID NO: 1079, SEQ ID NO: 1083, SEQ ID NO: 1093, SEQ ID NO: 1097, SEQ ID NO: 1107, SEQ ID NO: 1111, SEQ ID NO: 1121, SEQ ID NO: 1125, SEQ ID NO: 1135, SEQ ID NO: 1139, SEQ ID NO: 1149, SEQ ID NO: 1153, SEQ ID NO: 1163, SEQ ID NO: 1167, SEQ ID NO: 1177, SEQ ID NO: 1181, SEQ ID NO: 1191, SEQ ID NO: 1195, SEQ ID NO: 1205, SEQ ID NO: 1209, SEQ ID NO: 1219, SEQ ID NO: 1223, SEQ ID NO: 1233, SEQ ID NO: 1237, SEQ ID NO: 1247, SEQ ID NO: 1251, SEQ ID NO: 1261, SEQ ID NO: 1265, SEQ ID NO: 1275, SEQ ID NO: 1279, SEQ ID NO: 1289, SEQ ID NO: 1293, SEQ ID NO: 1303, SEQ ID NO: 1307, SEQ ID NO: 1317, SEQ ID NO: 1321, SEQ ID NO: 1331, SEQ ID NO: 1335, SEQ ID NO: 1345, SEQ ID NO: 1349, SEQ ID NO: 1359, SEQ ID NO: 1363, SEQ ID NO: 1373, SEQ ID NO: 1377, SEQ ID NO: 1387, SEQ ID NO: 1391, SEQ ID NO: 1401, SEQ ID NO: 1405, SEQ ID NO: 1415, SEQ ID NO: 1419, SEQ ID NO: 1429, SEQ ID NO: 1433, SEQ ID NO: 1443, SEQ ID NO: 1447, SEQ ID NO: 1457, SEQ ID NO: 1461, SEQ ID NO: 1471, SEQ ID NO: 1475, SEQ ID NO: 1485, SEQ ID NO: 1489, SEQ ID NO: 1499, SEQ ID NO: 1503, SEQ ID NO: 1513, SEQ ID NO: 1517, SEQ ID NO: 1527, SEQ ID NO: 1531, SEQ ID NO: 1541, SEQ ID NO: 1545, SEQ ID NO: 1555, SEQ ID NO: 1559, SEQ ID NO: 1569, and SEQ ID NO: 1573.

Preferred is when the first binding domain of the antibody construct of the invention comprises a VL region selected from the group consisting of those depicted in SEQ ID NO: 1051, SEQ ID NO: 1093, SEQ ID NO: 1149, SEQ ID NO: 1177, SEQ ID NO: 1191, SEQ ID NO: 1219, SEQ ID NO: 1233, SEQ ID NO: 1247, SEQ ID NO: 1261, SEQ ID NO: 1275, SEQ ID NO: 1345, SEQ ID NO: 1359, SEQ ID NO: 1373, SEQ ID NO: 1429, and SEQ ID NO: 1443.

In another embodiment, the first binding domain of the antibody construct of the invention comprises a VH region and a VL region selected from the group consisting of pairs of a VH region and a VL region as depicted in SEQ ID NOs: 7+8, SEQ ID NOs: 17+18, SEQ ID NOs: 27+28, SEQ ID NOs: 37+38, SEQ ID NOs: 47+48, SEQ ID NOs: 57+58, SEQ ID NOs: 67+68, SEQ ID NOs: 77+78, SEQ ID NOs: 87+88, SEQ ID NOs: 97+98, SEQ ID NOs: 107+108, SEQ ID NOs: 117+118, SEQ ID NOs: 127+128, SEQ ID NOs: 137+138, SEQ ID NOs: 147+148, SEQ ID NOs: 157+158, SEQ ID NOs: 167+168, SEQ ID NOs: 177+178, SEQ ID NOs: 187+188, SEQ ID NOs: 197+198, SEQ ID NOs: 207+208, SEQ ID NOs: 217+218, SEQ ID NOs: 227+228, SEQ ID NOs: 237+238, SEQ ID NOs: 247+248, SEQ ID NOs: 257+258, SEQ ID NOs: 267+268, SEQ ID NOs: 277+278, SEQ ID NOs: 287+288, SEQ ID NOs: 297+298, SEQ ID NOs: 307+308, SEQ ID NOs: 317+318, SEQ ID NOs: 327+328, SEQ ID NOs: 337+338, SEQ ID NOs: 347+348, SEQ ID NOs: 357+358, SEQ ID NOs: 367+368, SEQ ID NOs: 377+378, SEQ ID NOs: 387+388, SEQ ID NOs: 397+398, SEQ ID NOs: 407+408, SEQ ID NOs: 417+418, SEQ ID NOs: 427+428, SEQ ID NOs: 437+438, SEQ ID NOs: 447+448, SEQ ID NOs: 457+458, SEQ ID NOs: 467+468, SEQ ID NOs: 477+478, SEQ ID NOs: 487+488, SEQ ID NOs: 497+498, SEQ ID NOs: 507+508, SEQ ID NOs: 517+518, SEQ ID NOs: 527+528, SEQ ID NOs: 537+538, SEQ ID NOs: 547+548, SEQ ID NOs: 557+558, SEQ ID NOs: 567+568, SEQ ID NOs: 577+578, SEQ ID NOs: 587+588, SEQ ID NOs: 597+598, SEQ ID NOs: 607+608, SEQ ID NOs: 617+618, SEQ ID NOs: 627+628, SEQ ID NOs: 637+638, SEQ ID NOs: 647+648, SEQ ID NOs: 657+658, SEQ ID NOs: 667+668, SEQ ID NOs: 677+678, SEQ ID NOs: 687+688, SEQ ID NOs: 697+698, SEQ ID NOs: 707+708, SEQ ID NOs: 717+718, SEQ ID NOs: 727+728, SEQ ID NOs: 737+738, SEQ ID NOs: 920+921, SEQ ID NOs: 924+925, SEQ ID NOs: 928+929, SEQ ID NOs: 932+933, SEQ ID NOs: 936+937, SEQ ID NOs: 940+941, SEQ ID NOs: 944+945, SEQ ID NOs: 948+949, SEQ ID NOs: 952+953, SEQ ID NOs: 956+957, SEQ ID NOs: 960+961, SEQ ID NOs: 964+965, SEQ ID NOs: 968+969, SEQ ID NOs: 972+973, SEQ ID NOs: 976+977, SEQ ID NOs: 980+981, SEQ ID NOs: 984+985, SEQ ID NOs: 988+989, SEQ ID NOs: 992+993, SEQ ID NOs: 996+997, SEQ ID NOs: 1000+1001, SEQ ID NOs: 1004+1005, SEQ ID NOs: 1008+1009, SEQ ID NOs: 1012+1013, SEQ ID NOs: 1016+1017, SEQ ID NOs: 1020+1021, SEQ ID NOs: 1024+1025, SEQ ID NOs: 1028+1029, SEQ ID NOs: 1032+1033, SEQ ID NOs: 1036+1037, SEQ ID NOs: 1040+1041, SEQ ID NOs: 1050+1051, SEQ ID NOs: 1054+1055, SEQ ID NOs: 1064+1065, SEQ ID NOs: 1068+1069, SEQ ID NOs: 1078+1079, SEQ ID NOs: 1082+1083, SEQ ID NOs: 1092+1093, SEQ ID NOs: 1096+1097, SEQ ID NOs: 1106+1107, SEQ ID NOs: 1110+1111, SEQ ID NOs: 1120+1121, SEQ ID NOs: 1124+1125, SEQ ID NOs: 1134+1135, SEQ ID NOs: 1138+1139, SEQ ID NOs: 1148+1149, SEQ ID NOs: 1152+1153, SEQ ID NOs: 1162+1163, SEQ ID NOs: 1166+1167, SEQ ID NOs: 1176+1177, SEQ ID NOs: 1180+1181, SEQ ID NOs: 1190+1191, SEQ ID NOs: 1194+1195, SEQ ID NOs: 1204+1205, SEQ ID NOs: 1208+1209, SEQ ID NOs: 1218+1219, SEQ ID NOs: 1222+1223, SEQ ID NOs: 1232+1233, SEQ ID NOs: 1236+1237, SEQ ID NOs: 1246+1247, SEQ ID NOs: 1250+1251, SEQ ID NOs: 1260+1261, SEQ ID NOs: 1264+1265, SEQ ID NOs: 1274+1275, SEQ ID NOs: 1278+1279, SEQ ID NOs: 1288+1289, SEQ ID NOs: 1292+1293, SEQ ID NOs: 1302+1303, SEQ ID NOs: 1306+1307, SEQ ID NOs: 1316+1317, SEQ ID NOs: 1320+1321, SEQ ID NOs: 1330+1331, SEQ ID NOs: 1334+1335, SEQ ID NOs: 1344+1345, SEQ ID NOs: 1348+1349, SEQ ID NOs: 1358+1359, SEQ ID NOs: 1362+1363, SEQ ID NOs: 1372+1373, SEQ ID NOs: 1376+1377, SEQ ID NOs: 1386+1387, SEQ ID NOs: 1390+1391, SEQ ID NOs: 1400+1401, SEQ ID NOs: 1404+1405, SEQ ID NOs: 1414+1415, SEQ ID NOs: 1418+1419, SEQ ID NOs: 1428+1429, SEQ ID NOs: 1432+1433, SEQ ID NOs: 1442+1443, SEQ ID NOs: 1446+1447, SEQ ID NOs: 1456+1457, SEQ ID NOs: 1460+1461, SEQ ID NOs: 1470+1471, SEQ ID NOs: 1474+1475, SEQ ID NOs: 1484+1485, SEQ ID NOs: 1488+1489, SEQ ID NOs: 1498+1499, SEQ ID NOs: 1502+1503, SEQ ID NOs: 1512+1513, SEQ ID NOs: 1516+1517, SEQ ID NOs: 1526+1527, SEQ ID NOs: 1530+1531, SEQ ID NOs: 1540+1541, SEQ ID NOs: 1544+1545, SEQ ID NOs: 1554+1555, SEQ ID NOs: 1558+1559, SEQ ID NOs: 1568+1569, and SEQ ID NOs: 1572+1573.

Preferred is when the first binding domain of the antibody construct of the invention comprises a VH region and a VL region selected from the group consisting of pairs of a VH region and a VL region as depicted in SEQ ID NOs: 1050+1051, SEQ ID NOs: 1092+1093, SEQ ID NOs: 1148+1149, SEQ ID NOs: 1176+1177, SEQ ID NOs: 1190+1191, SEQ ID NOs: 1218+1219, SEQ ID NOs: 1232+1233, SEQ ID NOs: 1246+1247, SEQ ID NOs: 1260+1261, SEQ ID NOs: 1274+1275, SEQ ID NOs: 1344+1345, SEQ ID NOs: 1358+1359, NOs: 1372+1373, SEQ ID NOs: 1428+1429, and SEQ ID NOs: 1442+1443.

In yet a further embodiment, the first binding domain of the antibody construct of the invention comprises a polypeptide selected from the group consisting of those depicted in SEQ ID NO: 9, SEQ ID NO: 19, SEQ ID NO: 29, SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 179, SEQ ID NO: 189, SEQ ID NO: 199, SEQ ID NO: 209, SEQ ID NO: 219, SEQ ID NO: 229, SEQ ID NO: 239, SEQ ID NO: 249, SEQ ID NO: 259, SEQ ID NO: 269, SEQ ID NO: 279, SEQ ID NO: 289, SEQ ID NO:

299, SEQ ID NO: 309, SEQ ID NO: 319, SEQ ID NO: 329, SEQ ID NO: 339, SEQ ID NO: 349, SEQ ID NO: 359, SEQ ID NO: 369, SEQ ID NO: 379, SEQ ID NO: 389, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, SEQ ID NO: 509, SEQ ID NO: 519, SEQ ID NO: 529, SEQ ID NO: 539, SEQ ID NO: 549, SEQ ID NO: 559, SEQ ID NO: 569, SEQ ID NO: 579, SEQ ID NO: 589, SEQ ID NO: 599, SEQ ID NO: 609, SEQ ID NO: 619, SEQ ID NO: 629, SEQ ID NO: 639, SEQ ID NO: 649, SEQ ID NO: 659, SEQ ID NO: 669, SEQ ID NO: 679, SEQ ID NO: 689, SEQ ID NO: 699, SEQ ID NO: 709, SEQ ID NO: 719, SEQ ID NO: 729, SEQ ID NO: 739, SEQ ID NO: 922, SEQ ID NO: 926, SEQ ID NO: 930, SEQ ID NO: 934, SEQ ID NO: 938, SEQ ID NO: 942, SEQ ID NO: 946, SEQ ID NO: 950, SEQ ID NO: 954, SEQ ID NO: 958, SEQ ID NO: 962, SEQ ID NO: 966, SEQ ID NO: 970, SEQ ID NO: 974, SEQ ID NO: 978, SEQ ID NO: 982, SEQ ID NO: 986, SEQ ID NO: 990, SEQ ID NO: 994, SEQ ID NO: 998, SEQ ID NO: 1002, SEQ ID NO: 1006, SEQ ID NO: 1010, SEQ ID NO: 1014, SEQ ID NO: 1018, SEQ ID NO: 1022, SEQ ID NO: 1026, SEQ ID NO: 1030, SEQ ID NO: 1034, SEQ ID NO: 1038, SEQ ID NO: 1042, SEQ ID NO: 1052, SEQ ID NO: 1056, SEQ ID NO: 1066, SEQ ID NO: 1070, SEQ ID NO: 1080, SEQ ID NO: 1084, SEQ ID NO: 1094, SEQ ID NO: 1098, SEQ ID NO: 1108, SEQ ID NO: 1112, SEQ ID NO: 1122, SEQ ID NO: 1126, SEQ ID NO: 1136, SEQ ID NO: 1140, SEQ ID NO: 1150, SEQ ID NO: 1154, SEQ ID NO: 1164, SEQ ID NO: 1168, SEQ ID NO: 1178, SEQ ID NO: 1182, SEQ ID NO: 1192, SEQ ID NO: 1196, SEQ ID NO: 1206, SEQ ID NO: 1210, SEQ ID NO: 1220, SEQ ID NO: 1224, SEQ ID NO: 1234, SEQ ID NO: 1238, SEQ ID NO: 1248, SEQ ID NO: 1252, SEQ ID NO: 1262, SEQ ID NO: 1266, SEQ ID NO: 1276, SEQ ID NO: 1280, SEQ ID NO: 1290, SEQ ID NO: 1294, SEQ ID NO: 1304, SEQ ID NO: 1308, SEQ ID NO: 1318, SEQ ID NO: 1322, SEQ ID NO: 1332, SEQ ID NO: 1336, SEQ ID NO: 1346, SEQ ID NO: 1350, SEQ ID NO: 1360, SEQ ID NO: 1364, SEQ ID NO: 1374, SEQ ID NO: 1378, SEQ ID NO: 1388, SEQ ID NO: 1392, SEQ ID NO: 1402, SEQ ID NO: 1406, SEQ ID NO: 1416, SEQ ID NO: 1420, SEQ ID NO: 1430, SEQ ID NO: 1434, SEQ ID NO: 1444, SEQ ID NO: 1448, SEQ ID NO: 1458, SEQ ID NO: 1462, SEQ ID NO: 1472, SEQ ID NO: 1476, SEQ ID NO: 1486, SEQ ID NO: 1490, SEQ ID NO: 1500, SEQ ID NO: 1504, SEQ ID NO: 1514, SEQ ID NO: 1518, SEQ ID NO: 1528, SEQ ID NO: 1532, SEQ ID NO: 1542, SEQ ID NO: 1546, SEQ ID NO: 1556, SEQ ID NO: 1560, SEQ ID NO: 1570, and SEQ ID NO: 1574.

Preferred is when the first binding domain of the antibody construct of the invention comprises a polypeptide selected from the group consisting of those depicted in SEQ ID NO: 1052, SEQ ID NO: 1094, SEQ ID NO: 1150, SEQ ID NO: 1178, SEQ ID NO: 1192, SEQ ID NO: 1220, SEQ ID NO: 1234, SEQ ID NO: 1248, SEQ ID NO: 1262, SEQ ID NO: 1276, SEQ ID NO: 1346, SEQ ID NO: 1360, SEQ ID NO: 1374, SEQ ID NO: 1430, and SEQ ID NO: 1444.

The term "bispecific" as used herein refers to an antibody construct which is "at least bispecific", i.e., it comprises at least a first binding domain and a second binding domain, wherein the first binding domain binds to one antigen or target (here: CD70), and the second binding domain binds to another antigen or target (here: CD3). Accordingly, antibody constructs according to the invention comprise specificities for at least two different antigens or targets. The term "bispecific antibody construct" of the invention also encompasses multispecific antibody constructs such as trispecific antibody constructs, the latter ones including three binding domains, or constructs having more than three (e.g. four, five . . . ) specificities.

Given that the antibody constructs according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sites with different specificities. Bispecific antibody constructs can be produced by a variety of methods including fusion of hybridomas or linking of Fab' fragments. See, e.g., Songsivilai & Lachmann, Clin. Exp. Immunol. 79:315-321 (1990).

The at least two binding domains and the variable domains of the antibody construct of the present invention may or may not comprise peptide linkers (spacer peptides). The term "peptide linker" comprises in accordance with the present invention an amino acid sequence by which the amino acid sequences of one (variable and/or binding) domain and another (variable and/or binding) domain of the antibody construct of the invention are linked with each other. An essential technical feature of such peptide linker is that it does not comprise any polymerization activity. Among the suitable peptide linkers are those described in U.S. Pat. Nos. 4,751,180 and 4,935,233 or WO 88/09344. The peptide linkers can also be used to attach other domains or modules or regions (such as half-life extending domains) to the antibody construct of the invention.

In the event that a linker is used, this linker is preferably of a length and sequence sufficient to ensure that each of the first and second domains can, independently from one another, retain their differential binding specificities. For peptide linkers which connect the at least two binding domains (or two variable domains) in the antibody construct of the invention, those peptide linkers are preferred which comprise only a few number of amino acid residues, e.g. 12 amino acid residues or less. Thus, peptide linkers of 12, 11, 10, 9, 8, 7, 6 or 5 amino acid residues are preferred. An envisaged peptide linker with less than 5 amino acids comprises 4, 3, 2 or one amino acid(s), wherein Gly-rich linkers are preferred. A particularly preferred "single" amino acid in the context of said "peptide linker" is Gly. Accordingly, said peptide linker may consist of the single amino acid Gly. Another preferred embodiment of a peptide linker is characterized by the amino acid sequence Gly-Gly-Gly-Gly-Ser, i.e. $Gly_4Ser$ (SEQ ID NO: 771), or polymers thereof, i.e. $(Gly_4Ser)x$, where x is an integer of 1 or greater (e.g. 2 or 3). Preferred linkers are depicted in SEQ ID NOs: 770-778. The characteristics of said peptide linker, which comprise the absence of the promotion of secondary structures, are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which furthermore do not promote any secondary structures are preferred. The linkage of said domains to each other can be provided, e.g., by genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, New York, 2001).

As described herein above, the invention provides a preferred embodiment wherein the antibody construct is in a format selected from the group consisting of (scFv)2, scFv-single domain mAb, diabodies and oligomers of any of the aforementioned formats. The term "is in a format" does not exclude that the construct can be further modified by attachment or fusion to other moieties, as described herein.

According to a particularly preferred embodiment, and as documented in the appended examples, the antibody construct of the invention is a "bispecific single chain antibody construct", more preferably a bispecific "single chain Fv" (scFv). Although the two domains of the Fv fragment, VL and VH, are coded for by separate genes, they can be joined, using recombinant methods, by a synthetic linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain molecules are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dübel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format (scFv)2 can be engineered by linking two scFv molecules (e.g. with linkers as described hereinbefore). If these two scFv molecules have the same binding specificity, the resulting (scFv)2 molecule will preferably be called bivalent (i.e. it has two valences for the same target epitope). If the two scFv molecules have different binding specificities, the resulting (scFv)2 molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8.).

According to a further preferred embodiment of the antibody construct of the invention the heavy chain (VH) and the light chain (VL) of a binding domain (binding either to the target antigen CD70 or to CD3) are not directly connected via a peptide linker as described above, but the binding domains are formed as described for the diabody. Thus, the VH of the CD3 binding domain may be fused to the VL of the CD70 binding domain via a peptide linker, and the VH of the CD70 binding domain is fused to the VL of the CD3 binding domain via such peptide linker.

Single domain antibodies comprise merely one (monomeric) antibody variable domain which is able to bind selectively to a specific antigen, independently of other V regions or domains. The first single domain antibodies were engineered from heavy chain antibodies found in camelids, and these are called VHH fragments. Cartilaginous fishes also have heavy chain antibodies (IgNAR) from which single domain antibodies called VNAR fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)2 is hence a monoclonal antibody construct composed of (at least) two single domain monoclonal antibodies, which are individually selected from the group comprising VH, VL, VHH and VNAR. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

It is also envisaged that the antibody construct of the invention has, in addition to its function to bind to the target molecules CD70 and CD3, a further function. In this format, the antibody construct is a trifunctional or multifunctional antibody construct by targeting target cells through binding to CD70, mediating cytotoxic T cell activity through CD3 binding and providing a further function such as a fully functional Fc constant domain mediating antibody-dependent cellular cytotoxicity through recruitment of effector cells like NK cells, a label (fluorescent etc.), a therapeutic agent such as a toxin or radionuclide, and/or means to enhance serum half-life, etc.

Examples for means to extend serum half-life of the antibody constructs of the invention include peptides, proteins or domains of proteins, which are fused or otherwise attached to the antibody constructs. The group of peptides, proteins or protein domains includes peptides binding to other proteins with preferred pharmacokinetic profile in the human body such as serum albumin (see WO 2009/127691). An alternative concept of such half-life extending peptides includes peptides binding to the neonatal Fc receptor (FcRn, see WO 2007/098420), which can also be used in the constructs of the present invention. The concept of attaching larger domains of proteins or complete proteins includes e.g. the fusion of human serum albumin, variants or mutants of human serum albumin (see WO 2011/051489, WO 2012/059486, WO 2012/150319, WO 2013/135896, WO 2014/072481, WO 2013/075066) or domains thereof as well as the fusion of constant region of immunoglobulins (Fc domains) and variants thereof. Such variants of Fc domains may be optimized/modified in order to allow the desired pairing of dimers or multimers, to abolish Fc receptor binding (e.g. the Fcγ receptor) or for other reasons. A further concept known in the art to extend the half-life of small protein compounds in the human body is the pegylation of those compounds such as the antibody construct of the present invention.

In a preferred embodiment, the bispecific antibody constructs according to the invention may be linked (e.g. via peptide bond) with a fusion partner (such as a protein or polypeptide or peptide), e.g. for the purpose of extending the construct's serum half-life. These fusion partners can be selected from human serum albumin ("HSA" or "HALB") as wells as sequence variants thereof, peptides binding to HSA, peptides binding to FcRn ("FcRn BP"), or constructs comprising an (antibody derived) Fc region. Exemplary sequences of these fusion partners are depicted in SEQ ID NOs: 780-826. In general, the fusion partners may be linked to the N-terminus or to the C-terminus of the bispecific antibody constructs according to the invention, either directly (e.g. via peptide bond) or through a peptide linker such as (GGGGS)n (wherein "n" is an integer of 2 or greater, e.g. 2 or 3 or 4). Suitable peptide linkers are depicted in SEQ ID NOs: 770-778.

Hence, a preferred antibody construct according to the present invention comprises:

(a) a polypeptide comprising in the following order starting from the N-terminus:
 a polypeptide having an amino acid sequence selected from the group consisting of SEQ ID NO: 9, SEQ ID NO: 19, SEQ ID NO: 29, SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 179, SEQ ID NO: 189, SEQ ID NO: 199, SEQ ID NO: 209, SEQ ID NO: 219, SEQ ID NO: 229, SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 319, SEQ ID NO: 329, SEQ ID NO: 339, SEQ ID NO: 349, SEQ ID NO: 359, SEQ ID NO: 369, SEQ ID NO: 379, SEQ ID NO: 389, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, SEQ ID NO: 509, SEQ ID NO: 519, SEQ ID NO: 529, SEQ ID NO: 539, SEQ ID NO: 549, SEQ ID NO: 559, SEQ ID NO: 569, SEQ ID NO: 579, SEQ ID NO: 589, SEQ ID NO: 599, SEQ ID NO: 609, SEQ ID NO: 619, SEQ ID NO: 629, SEQ ID NO: 639, SEQ ID NO: 649, SEQ ID NO: 659, SEQ ID NO: 669, SEQ ID NO: 679, SEQ ID NO: 689, SEQ ID NO: 699, SEQ ID NO: 709, SEQ ID NO: 719, SEQ ID NO: 729, SEQ ID NO: 739, SEQ ID NO: 922, SEQ ID NO: 926, SEQ ID NO: 930, SEQ ID NO: 934, SEQ ID NO: 938, SEQ ID NO: 942, SEQ ID NO: 946, SEQ ID NO: 950, SEQ ID NO: 954, SEQ ID NO: 958, SEQ ID NO: 962, SEQ ID NO: 966, SEQ ID NO: 970, SEQ ID NO: 974, SEQ ID NO: 978, SEQ ID NO: 982, SEQ ID NO: 986, SEQ ID NO: 990, SEQ ID NO: 994, SEQ ID NO: 998, SEQ ID NO: 1002, SEQ ID NO: 1006, SEQ ID NO: 1010, SEQ ID NO: 1014, SEQ ID NO: 1018, SEQ ID NO: 1022, SEQ ID NO: 1026, SEQ ID NO: 1030, SEQ ID NO: 1034, SEQ ID NO: 1038, SEQ ID NO: 1042, SEQ ID NO: 1052, SEQ ID NO: 1056, SEQ ID NO: 1066, SEQ ID NO: 1070, SEQ ID NO: 1080, SEQ ID NO: 1084, SEQ ID NO: 1094, SEQ ID NO: 1098, SEQ ID NO: 1108, SEQ ID NO: 1112, SEQ ID NO: 1122, SEQ ID NO: 1126, SEQ ID NO: 1136, SEQ ID NO: 1140, SEQ ID NO: 1150, SEQ ID NO: 1154, SEQ ID NO: 1164, SEQ ID NO: 1168, SEQ ID NO: 1178, SEQ ID NO: 1182, SEQ ID NO: 1192, SEQ ID NO: 1196, SEQ ID NO: 1206, SEQ ID NO: 1210, SEQ ID NO: 1220, SEQ ID NO: 1224, SEQ ID NO: 1234, SEQ ID NO: 1238, SEQ ID NO: 1248, SEQ ID NO: 1252, SEQ ID NO: 1262, SEQ ID NO: 1266, SEQ ID NO: 1276, SEQ ID NO: 1280, SEQ ID NO: 1290, SEQ ID NO: 1294, SEQ ID NO: 1304, SEQ ID NO: 1308, SEQ ID NO: 1318, SEQ ID NO: 1322, SEQ ID NO: 1332, SEQ ID NO: 1336, SEQ ID NO: 1346, SEQ ID NO: 1350, SEQ ID NO: 1360, SEQ ID NO: 1364, SEQ ID NO: 1374, SEQ ID NO: 1378, SEQ ID NO: 1388, SEQ ID NO: 1392, SEQ ID NO: 1402, SEQ ID NO: 1406, SEQ ID NO: 1416, SEQ ID NO: 1420, SEQ ID NO: 1430, SEQ ID NO: 1434, SEQ ID NO: 1444, SEQ ID NO: 1448, SEQ ID NO: 1458, SEQ ID NO: 1462, SEQ ID NO: 1472, SEQ ID NO: 1476, SEQ ID NO: 1486, SEQ ID NO: 1490, SEQ ID NO: 1500, SEQ ID NO: 1504, SEQ ID NO: 1514, SEQ ID NO: 1518, SEQ ID NO: 1528, SEQ ID NO: 1532, SEQ ID NO: 1542, SEQ ID NO: 1546, SEQ ID NO: 1556, SEQ ID NO: 1560, SEQ ID NO: 1570, and SEQ ID NO: 1574;
 a peptide linker having an amino acid sequence selected from the group consisting of SEQ ID NOs: 770-778; and
 a polypeptide having an amino acid sequence selected from the group consisting of SEQ ID NO: 835, SEQ ID NO: 844, SEQ ID NO: 853, SEQ ID NO: 862, SEQ ID NO: 871, SEQ ID NO: 880, SEQ ID NO: 889, SEQ ID NO: 898, SEQ ID NO: 907, SEQ ID NO: 916, and SEQ ID NO: 919; and
 optionally a His-tag, such as the one depicted in SEQ ID NO 779;

(b) a polypeptide comprising in the following order starting from the N-terminus:
 a polypeptide having an amino acid sequence selected from the group consisting of SEQ ID NO: 9, SEQ ID NO: 19, SEQ ID NO: 29, SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 179, SEQ ID NO: 189, SEQ ID NO: 199, SEQ ID NO: 209, SEQ ID NO: 219, SEQ ID NO: 229, SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 319, SEQ ID NO: 329, SEQ ID NO: 339, SEQ ID NO: 349, SEQ ID NO: 359, SEQ ID NO: 369, SEQ ID NO: 379, SEQ ID NO: 389, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, SEQ ID NO: 509, SEQ ID NO: 519, SEQ ID NO: 529, SEQ ID NO: 539, SEQ ID NO: 549, SEQ ID NO: 559, SEQ ID NO: 569, SEQ ID NO: 579, SEQ ID NO: 589, SEQ ID NO: 599, SEQ ID NO: 609, SEQ ID NO: 619, SEQ ID NO: 629, SEQ ID NO: 639, SEQ ID NO: 649, SEQ ID NO: 659, SEQ ID NO: 669, SEQ ID NO: 679, SEQ ID NO: 689, SEQ ID NO: 699, SEQ ID NO: 709, SEQ ID NO: 719, SEQ ID NO: 729, SEQ ID NO: 739, SEQ ID NO: 922, SEQ ID NO: 926, SEQ ID NO: 930, SEQ ID NO: 934, SEQ ID NO: 938, SEQ ID NO: 942, SEQ ID NO: 946, SEQ ID NO: 950, SEQ ID NO: 954, SEQ ID NO: 958, SEQ ID NO: 962, SEQ ID NO: 966, SEQ ID NO: 970, SEQ ID NO: 974, SEQ ID NO: 978, SEQ ID NO: 982, SEQ ID NO: 986, SEQ ID NO: 990, SEQ ID NO: 994, SEQ ID NO: 998, SEQ ID NO: 1002, SEQ ID NO: 1006, SEQ ID NO: 1010, SEQ ID NO: 1014, SEQ ID NO: 1018, SEQ ID NO: 1022, SEQ ID NO: 1026, SEQ ID NO: 1030, SEQ ID NO: 1034, SEQ ID NO: 1038, SEQ ID NO: 1042, SEQ ID NO: 1052, SEQ ID NO: 1056, SEQ ID NO: 1066, SEQ ID NO: 1070, SEQ ID NO: 1080, SEQ ID NO: 1084, SEQ ID NO: 1094, SEQ ID NO: 1098, SEQ ID NO: 1108, SEQ ID NO: 1112, SEQ ID NO: 1122, SEQ ID NO: 1126, SEQ ID NO: 1136, SEQ ID NO: 1140, SEQ ID NO: 1150, SEQ ID NO: 1154, SEQ ID NO: 1164, SEQ ID NO: 1168, SEQ ID NO: 1178, SEQ ID NO: 1182, SEQ ID NO: 1192, SEQ ID NO: 1196, SEQ ID NO: 1206, SEQ ID NO: 1210, SEQ ID NO: 1220, SEQ ID NO: 1224, SEQ ID NO: 1234, SEQ ID NO: 1238, SEQ ID NO: 1248, SEQ ID NO: 1252, SEQ ID NO: 1262, SEQ ID NO: 1266, SEQ ID NO: 1276, SEQ ID NO: 1280, SEQ ID NO: 1290, SEQ ID NO: 1294, SEQ ID NO: 1304, SEQ ID NO: 1308, SEQ ID NO: 1318, SEQ ID NO: 1322, SEQ ID NO: 1332, SEQ ID NO: 1336, SEQ ID NO: 1346, SEQ ID NO: 1350, SEQ ID NO: 1360, SEQ ID NO: 1364, SEQ ID NO: 1374, SEQ ID NO: 1378, SEQ ID NO: 1388, SEQ ID NO: 1392, SEQ ID NO: 1402, SEQ ID NO: 1406, SEQ ID NO: 1416, SEQ ID NO: 1420, SEQ ID NO: 1430, SEQ ID NO: 1434, SEQ ID NO: 1444, SEQ ID NO: 1448, SEQ ID NO: 1458, SEQ ID NO: 1462, SEQ ID NO: 1472, SEQ ID NO: 1476, SEQ ID NO: 1486, SEQ ID NO: 1490, SEQ ID NO: 1500, SEQ ID NO: 1504, SEQ ID NO: 1514, SEQ ID NO: 1518, SEQ ID NO: 1528, SEQ ID NO: 1532, SEQ ID NO: 1542, SEQ ID NO: 1546, SEQ ID NO: 1556, SEQ ID NO: 1560, SEQ ID NO: 1570, and SEQ ID NO: 1574;

a peptide linker having an amino acid sequence selected from the group consisting of SEQ ID NOs: 770-778;

a polypeptide having an amino acid sequence selected from the group consisting of SEQ ID NO: 835, SEQ ID NO: 844, SEQ ID NO: 853, SEQ ID NO: 862, SEQ ID NO: 871, SEQ ID NO: 880, SEQ ID NO: 889, SEQ ID NO: 898, SEQ ID NO: 907, SEQ ID NO: 916, and SEQ ID NO: 919;

optionally a peptide linker having an amino acid sequence selected from the group consisting of SEQ ID NOs: 770-778;

a polypeptide having an amino acid sequence selected from the group consisting of SEQ ID NOs: 780 and 786-815; and optionally a His-tag, such as the one depicted in SEQ ID NO 779;

(c) a polypeptide comprising in the following order starting from the N-terminus:

a polypeptide having the amino acid sequence QRFVTGHFGGLX1PANG (SEQ ID NO: 781) wherein X1 is Y or H; and a polypeptide having an amino acid sequence selected from the group consisting of SEQ ID NO: 9, SEQ ID NO: 19, SEQ ID NO: 29, SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 179, SEQ ID NO: 189, SEQ ID NO: 199, SEQ ID NO: 209, SEQ ID NO: 219, SEQ ID NO: 229, SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 319, SEQ ID NO: 329, SEQ ID NO: 339, SEQ ID NO: 349, SEQ ID NO: 359, SEQ ID NO: 369, SEQ ID NO: 379, SEQ ID NO: 389, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, SEQ ID NO: 509, SEQ ID NO: 519, SEQ ID NO: 529, SEQ ID NO: 539, SEQ ID NO: 549, SEQ ID NO: 559, SEQ ID NO: 569, SEQ ID NO: 579, SEQ ID NO: 589, SEQ ID NO: 599, SEQ ID NO: 609, SEQ ID NO: 619, SEQ ID NO: 629, SEQ ID NO: 639, SEQ ID NO: 649, SEQ ID NO: 659, SEQ ID NO: 669, SEQ ID NO: 679, SEQ ID NO: 689, SEQ ID NO: 699, SEQ ID NO: 709, SEQ ID NO: 719, SEQ ID NO: 729, SEQ ID NO: 739, SEQ ID NO: 922, SEQ ID NO: 926, SEQ ID NO: 930, SEQ ID NO: 934, SEQ ID NO: 938, SEQ ID NO: 942, SEQ ID NO: 946, SEQ ID NO: 950, SEQ ID NO: 954, SEQ ID NO: 958, SEQ ID NO: 962, SEQ ID NO: 966, SEQ ID NO: 970, SEQ ID NO: 974, SEQ ID NO: 978, SEQ ID NO: 982, SEQ ID NO: 986, SEQ ID NO: 990, SEQ ID NO: 994, SEQ ID NO: 998, SEQ ID NO: 1002, SEQ ID NO: 1006, SEQ ID NO: 1010, SEQ ID NO: 1014, SEQ ID NO: 1018, SEQ ID NO: 1022, SEQ ID NO: 1026, SEQ ID NO: 1030, SEQ ID NO: 1034, SEQ ID NO: 1038, SEQ ID NO: 1042, SEQ ID NO: 1052, SEQ ID NO: 1056, SEQ ID NO: 1066, SEQ ID NO: 1070, SEQ ID NO: 1080, SEQ ID NO: 1084, SEQ ID NO: 1094, SEQ ID NO: 1098, SEQ ID NO: 1108, SEQ ID NO: 1112, SEQ ID NO: 1122, SEQ ID NO: 1126, SEQ ID NO: 1136, SEQ ID NO: 1140, SEQ ID NO: 1150, SEQ ID NO: 1154, SEQ ID NO: 1164, SEQ ID NO: 1168, SEQ ID NO: 1178, SEQ ID NO: 1182, SEQ ID NO: 1192, SEQ ID NO: 1196, SEQ ID NO: 1206, SEQ ID NO: 1210, SEQ ID NO: 1220, SEQ ID NO: 1224, SEQ ID NO: 1234, SEQ ID NO: 1238, SEQ ID NO: 1248, SEQ ID NO: 1252, SEQ ID NO: 1262, SEQ ID NO: 1266, SEQ ID NO: 1276, SEQ ID NO: 1280, SEQ ID NO: 1290, SEQ ID NO: 1294, SEQ ID NO: 1304, SEQ ID NO: 1308, SEQ ID NO: 1318, SEQ ID NO: 1322, SEQ ID NO: 1332, SEQ ID NO: 1336, SEQ ID NO: 1346, SEQ ID NO: 1350, SEQ ID NO: 1360, SEQ ID NO: 1364, SEQ ID NO: 1374, SEQ ID NO: 1378, SEQ ID NO: 1388, SEQ ID NO: 1392, SEQ ID NO: 1402, SEQ ID NO: 1406, SEQ ID NO: 1416, SEQ ID NO: 1420, SEQ ID NO: 1430, SEQ ID NO: 1434, SEQ ID NO: 1444, SEQ ID NO: 1448, SEQ ID NO: 1458, SEQ ID NO: 1462, SEQ ID NO: 1472, SEQ ID NO: 1476, SEQ ID NO: 1486, SEQ ID NO: 1490, SEQ ID NO: 1500, SEQ ID NO: 1504, SEQ ID NO: 1514, SEQ ID NO: 1518, SEQ ID NO: 1528, SEQ ID NO: 1532, SEQ ID NO: 1542, SEQ ID NO: 1546, SEQ ID NO: 1556, SEQ ID NO: 1560, SEQ ID NO: 1570, and SEQ ID NO: 1574;

a peptide linker having an amino acid sequence selected from the group consisting of SEQ ID NOs: 770-778;

a polypeptide having an amino acid sequence selected from the group consisting of SEQ ID NO: 835, SEQ ID NO: 844, SEQ ID NO: 853, SEQ ID NO: 862, SEQ ID NO: 871, SEQ ID NO: 880, SEQ ID NO:

889, SEQ ID NO: 898, SEQ ID NO: 907, SEQ ID NO: 916, and SEQ ID NO: 919;

a polypeptide having the amino acid sequence QRFVTGHFGGLHPANG (SEQ ID NO: 783) or QRFCTGHFGGLHPCNG (SEQ ID NO: 785); and optionally a His-tag, such as the one depicted in SEQ ID NO 779;

(d) a polypeptide comprising in the following order starting from the N-terminus a polypeptide having an amino acid sequence selected from the group consisting of SEQ ID NO: 833, SEQ ID NO: 842, SEQ ID NO: 851, SEQ ID NO: 860, SEQ ID NO: 869, SEQ ID NO: 878, SEQ ID NO: 887, SEQ ID NO: 896, SEQ ID NO: 905, SEQ ID NO: 914, and SEQ ID NO: 917;

a peptide linker having the amino acid sequence depicted in SEQ ID NO: 777;

a polypeptide having an amino acid sequence selected from the group consisting of SEQ ID NO: 8, SEQ ID NO: 18, SEQ ID NO: 28, SEQ ID NO: 38, SEQ ID NO: 48, SEQ ID NO: 58, SEQ ID NO: 68, SEQ ID NO: 78, SEQ ID NO: 88, SEQ ID NO: 98, SEQ ID NO: 108, SEQ ID NO: 118, SEQ ID NO: 128, SEQ ID NO: 138, SEQ ID NO: 148, SEQ ID NO: 158, SEQ ID NO: 168, SEQ ID NO: 178, SEQ ID NO: 188, SEQ ID NO: 198, SEQ ID NO: 208, SEQ ID NO: 218, SEQ ID NO: 228, SEQ ID NO: 238, SEQ ID NO: 248, SEQ ID NO: 258, SEQ ID NO: 268, SEQ ID NO: 278, SEQ ID NO: 288, SEQ ID NO: 298, SEQ ID NO: 308, SEQ ID NO: 318, SEQ ID NO: 328, SEQ ID NO: 338, SEQ ID NO: 348, SEQ ID NO: 358, SEQ ID NO: 368, SEQ ID NO: 378, SEQ ID NO: 388, SEQ ID NO: 398, SEQ ID NO: 408, SEQ ID NO: 418, SEQ ID NO: 428, SEQ ID NO: 438, SEQ ID NO: 448, SEQ ID NO: 458, SEQ ID NO: 468, SEQ ID NO: 478, SEQ ID NO: 488, SEQ ID NO: 498, SEQ ID NO: 508, SEQ ID NO: 518, SEQ ID NO: 528, SEQ ID NO: 538, SEQ ID NO: 548, SEQ ID NO: 558, SEQ ID NO: 568, SEQ ID NO: 578, SEQ ID NO: 588, SEQ ID NO: 598, SEQ ID NO: 608, SEQ ID NO: 618, SEQ ID NO: 628, SEQ ID NO: 638, SEQ ID NO: 648, SEQ ID NO: 658, SEQ ID NO: 668, SEQ ID NO: 678, SEQ ID NO: 688, SEQ ID NO: 698, SEQ ID NO: 708, SEQ ID NO: 718, SEQ ID NO: 728, SEQ ID NO: 738, SEQ ID NO: 921, SEQ ID NO: 925, SEQ ID NO: 929, SEQ ID NO: 933, SEQ ID NO: 937, SEQ ID NO: 941, SEQ ID NO: 945, SEQ ID NO: 949, SEQ ID NO: 953, SEQ ID NO: 957, SEQ ID NO: 961, SEQ ID NO: 965, SEQ ID NO: 969, SEQ ID NO: 973, SEQ ID NO: 977, SEQ ID NO: 981, SEQ ID NO: 985, SEQ ID NO: 989, SEQ ID NO: 993, SEQ ID NO: 997, SEQ ID NO: 1001, SEQ ID NO: 1005, SEQ ID NO: 1009, SEQ ID NO: 1013, SEQ ID NO: 1017, SEQ ID NO: 1021, SEQ ID NO: 1025, SEQ ID NO: 1029, SEQ ID NO: 1033, SEQ ID NO: 1037, SEQ ID NO: 1041, SEQ ID NO: 1051, SEQ ID NO: 1055, SEQ ID NO: 1065, SEQ ID NO: 1069, SEQ ID NO: 1079, SEQ ID NO: 1083, SEQ ID NO: 1093, SEQ ID NO: 1097, SEQ ID NO: 1107, SEQ ID NO: 1111, SEQ ID NO: 1121, SEQ ID NO: 1125, SEQ ID NO: 1135, SEQ ID NO: 1139, SEQ ID NO: 1149, SEQ ID NO: 1153, SEQ ID NO: 1163, SEQ ID NO: 1167, SEQ ID NO: 1177, SEQ ID NO: 1181, SEQ ID NO: 1191, SEQ ID NO: 1195, SEQ ID NO: 1205, SEQ ID NO: 1209, SEQ ID NO: 1219, SEQ ID NO: 1223, SEQ ID NO: 1233, SEQ ID NO: 1237, SEQ ID NO: 1247, SEQ ID NO: 1251, SEQ ID NO: 1261, SEQ ID NO: 1265, SEQ ID NO: 1275, SEQ ID NO: 1279, SEQ ID NO: 1289, SEQ ID NO: 1293, SEQ ID NO: 1303, SEQ ID NO: 1307, SEQ ID NO: 1317, SEQ ID NO: 1321, SEQ ID NO: 1331, SEQ ID NO: 1335, SEQ ID NO: 1345, SEQ ID NO: 1349, SEQ ID NO: 1359, SEQ ID NO: 1363, SEQ ID NO: 1373, SEQ ID NO: 1377, SEQ ID NO: 1387, SEQ ID NO: 1391, SEQ ID NO: 1401, SEQ ID NO: 1405, SEQ ID NO: 1415, SEQ ID NO: 1419, SEQ ID NO: 1429, SEQ ID NO: 1433, SEQ ID NO: 1443, SEQ ID NO: 1447, SEQ ID NO: 1457, SEQ ID NO: 1461, SEQ ID NO: 1471, SEQ ID NO: 1475, SEQ ID NO: 1485, SEQ ID NO: 1489, SEQ ID NO: 1499, SEQ ID NO: 1503, SEQ ID NO: 1513, SEQ ID NO: 1517, SEQ ID NO: 1527, SEQ ID NO: 1531, SEQ ID NO: 1541, SEQ ID NO: 1545, SEQ ID NO: 1555, SEQ ID NO: 1559, SEQ ID NO: 1569, and SEQ ID NO: 1573, followed by a serine residue at the C-terminus;

a polypeptide having the amino acid sequence depicted in SEQ ID NO: 816; and a polypeptide comprising in the following order starting from the N-terminus:

a polypeptide having an amino acid sequence selected from the group consisting of SEQ ID NO: 7, SEQ ID NO: 17, SEQ ID NO: 27, SEQ ID NO: 37, SEQ ID NO: 47, SEQ ID NO: 57, SEQ ID NO: 67, SEQ ID NO: 77, SEQ ID NO: 87, SEQ ID NO: 97, SEQ ID NO: 107, SEQ ID NO: 117, SEQ ID NO: 127, SEQ ID NO: 137, SEQ ID NO: 147, SEQ ID NO: 157, SEQ ID NO: 167, SEQ ID NO: 177, SEQ ID NO: 187, SEQ ID NO: 197, SEQ ID NO: 207, SEQ ID NO: 217, SEQ ID NO: 227, SEQ ID NO: 237, SEQ ID NO: 247, SEQ ID NO: 257, SEQ ID NO: 267, SEQ ID NO: 277, SEQ ID NO: 287, SEQ ID NO: 297, SEQ ID NO: 307, SEQ ID NO: 317, SEQ ID NO: 327, SEQ ID NO: 337, SEQ ID NO: 347, SEQ ID NO: 357, SEQ ID NO: 367, SEQ ID NO: 377, SEQ ID NO: 387, SEQ ID NO: 397, SEQ ID NO: 407, SEQ ID NO: 417, SEQ ID NO: 427, SEQ ID NO: 437, SEQ ID NO: 447, SEQ ID NO: 457, SEQ ID NO: 467, SEQ ID NO: 477, SEQ ID NO: 487, SEQ ID NO: 497, SEQ ID NO: 507, SEQ ID NO: 517, SEQ ID NO: 527, SEQ ID NO: 537, SEQ ID NO: 547, SEQ ID NO: 557, SEQ ID NO: 567, SEQ ID NO: 577, SEQ ID NO: 587, SEQ ID NO: 597, SEQ ID NO: 607, SEQ ID NO: 617, SEQ ID NO: 627, SEQ ID NO: 637, SEQ ID NO: 647, SEQ ID NO: 657, SEQ ID NO: 667, SEQ ID NO: 677, SEQ ID NO: 687, SEQ ID NO: 697, SEQ ID NO: 707, SEQ ID NO: 717, SEQ ID NO: 727, SEQ ID NO: 737; SEQ ID NO: 920, SEQ ID NO: 924, SEQ ID NO: 928, SEQ ID NO: 932, SEQ ID NO: 936, SEQ ID NO: 940, SEQ ID NO: 944, SEQ ID NO: 948, SEQ ID NO: 952, SEQ ID NO: 956, SEQ ID NO: 960, SEQ ID NO: 964, SEQ ID NO: 968, SEQ ID NO: 972, SEQ ID NO: 976, SEQ ID NO: 980, SEQ ID NO: 984, SEQ ID NO: 988, SEQ ID NO: 992, SEQ ID NO: 996, SEQ ID NO: 1000, SEQ ID NO: 1004, SEQ ID NO: 1008, SEQ ID NO: 1012, SEQ ID NO: 1016, SEQ ID NO: 1020, SEQ ID NO: 1024, SEQ ID NO: 1028, SEQ ID NO: 1032, SEQ ID NO: 1036, SEQ ID NO: 1040, SEQ ID NO: 1050, SEQ ID NO: 1054, SEQ ID NO: 1064, SEQ ID NO: 1068, SEQ ID NO: 1078, SEQ ID NO: 1082, SEQ ID NO: 1092, SEQ ID NO: 1096, SEQ ID NO: 1106, SEQ ID NO: 1110, SEQ ID NO: 1120, SEQ ID NO: 1124, SEQ ID NO: 1134, SEQ ID NO: 1138, SEQ ID NO: 1148, SEQ ID NO: 1152, SEQ ID NO: 1162, SEQ ID NO: 1166, SEQ ID NO: 1176, SEQ ID NO: 1180, SEQ ID NO: 1190, SEQ ID NO: 1194, SEQ ID NO: 1204, SEQ ID NO: 1208, SEQ ID NO: 1218, SEQ ID NO: 1222, SEQ ID NO: 1232, SEQ ID NO: 1236, SEQ ID NO: 1246, SEQ ID NO: 1250, SEQ ID NO: 1260, SEQ ID NO: 1264, SEQ ID NO: 1274, SEQ ID NO: 1278, SEQ ID NO: 1288, SEQ ID NO: 1292, SEQ ID NO: 1302, SEQ ID NO: 1306, SEQ ID NO: 1316, SEQ ID NO: 1320, SEQ ID NO: 1330, SEQ ID NO: 1334, SEQ ID NO: 1344, SEQ ID NO: 1348, SEQ ID NO: 1358, SEQ ID NO: 1362, SEQ ID NO: 1372, SEQ ID NO: 1376, SEQ ID NO: 1386, SEQ ID NO: 1390, SEQ ID NO: 1400, SEQ ID NO: 1404, SEQ ID NO: 1414, SEQ ID NO: 1418, SEQ ID NO: 1428, SEQ ID NO: 1432, SEQ ID NO: 1442, SEQ ID NO: 1446, SEQ ID NO: 1456, SEQ ID NO: 1460, SEQ ID NO: 1470, SEQ ID NO: 1474, SEQ ID NO: 1484, SEQ ID NO: 1488, SEQ ID NO: 1498, SEQ ID NO: 1502, SEQ ID NO: 1512, SEQ ID NO: 1516, SEQ ID NO: 1526, SEQ ID NO: 1530, SEQ ID NO: 1540, SEQ ID NO: 1544, SEQ ID NO: 1554, SEQ ID NO: 1558, SEQ ID NO: 1568, and SEQ ID NO: 1572;

a peptide linker having the amino acid sequence depicted in SEQ ID NO: 777;

a polypeptide having an amino acid sequence selected from the group consisting of SEQ ID NO: 834, SEQ ID NO: 843, SEQ ID NO: 852, SEQ ID NO: 861, SEQ ID NO: 870, SEQ ID NO: 879, SEQ ID NO: 888, SEQ ID NO: 897, SEQ ID NO: 906, SEQ ID NO: 915, and SEQ ID NO: 918 followed by a serine residue at the C-terminus; and a polypeptide having the amino acid sequence depicted in SEQ ID NO: 817;

(e) a polypeptide comprising in the following order starting from the N-terminus:

a polypeptide having an amino acid sequence selected from the group consisting of SEQ ID NO: 833, SEQ ID NO: 842, SEQ ID NO: 851, SEQ ID NO: 860, SEQ ID NO: 869, SEQ ID NO: 878, SEQ ID NO: 887, SEQ ID NO: 896, SEQ ID NO: 905, SEQ ID NO: 914, and SEQ ID NO: 917;

a peptide linker having the amino acid sequence depicted in SEQ ID NO: 777;

a polypeptide having an amino acid sequence selected from the group consisting of SEQ ID NO: 8, SEQ ID NO: 18, SEQ ID NO: 28, SEQ ID NO: 38, SEQ ID NO: 48, SEQ ID NO: 58, SEQ ID NO: 68, SEQ ID NO: 78, SEQ ID NO: 88, SEQ ID NO: 98, SEQ ID NO: 108, SEQ ID NO: 118, SEQ ID NO: 128, SEQ ID NO: 138, SEQ ID NO: 148, SEQ ID NO: 158, SEQ ID NO: 168, SEQ ID NO: 178, SEQ ID NO: 188, SEQ ID NO: 198, SEQ ID NO: 208, SEQ ID NO: 218, SEQ ID NO: 228, SEQ ID NO: 238, SEQ ID NO: 248, SEQ ID NO: 258, SEQ ID NO: 268, SEQ ID NO: 278, SEQ ID NO: 288, SEQ ID NO: 298, SEQ ID NO: 308, SEQ ID NO: 318, SEQ ID NO: 328, SEQ ID NO: 338, SEQ ID NO: 348, SEQ ID NO: 358, SEQ ID NO: 368, SEQ ID NO: 378, SEQ ID NO: 388, SEQ ID NO: 398, SEQ ID NO: 408, SEQ ID NO: 418, SEQ ID NO: 428, SEQ ID NO: 438, SEQ ID NO: 448, SEQ ID NO: 458, SEQ ID NO: 468, SEQ ID NO: 478, SEQ ID NO: 488, SEQ ID NO: 498, SEQ ID NO: 508, SEQ ID NO: 518, SEQ ID NO: 528, SEQ ID NO: 538, SEQ ID NO: 548, SEQ ID NO: 558, SEQ ID NO: 568, SEQ ID NO: 578, SEQ ID NO: 588, SEQ ID NO: 598, SEQ ID NO: 608, SEQ ID NO: 618, SEQ ID NO: 628, SEQ ID NO: 638, SEQ ID NO: 648, SEQ ID NO: 658, SEQ ID NO: 668, SEQ ID NO: 678, SEQ ID NO: 688, SEQ ID NO: 698, SEQ ID NO: 708, SEQ ID NO: 718, SEQ ID NO: 728, SEQ ID NO: 738, SEQ ID NO: 921, SEQ ID NO: 925, SEQ ID NO: 929, SEQ ID NO: 933, SEQ ID NO: 937, SEQ ID NO: 941, SEQ ID NO: 945, SEQ ID NO: 949, SEQ ID NO: 953, SEQ ID NO: 957, SEQ ID NO: 961, SEQ ID NO: 965, SEQ ID NO: 969, SEQ ID NO: 973, SEQ ID NO: 977, SEQ ID NO: 981, SEQ ID NO: 985, SEQ ID NO: 989, SEQ ID NO: 993, SEQ ID NO: 997, SEQ ID NO: 1001, SEQ ID NO: 1005, SEQ ID NO: 1009, SEQ ID NO: 1013, SEQ ID NO: 1017, SEQ ID NO: 1021, SEQ ID NO: 1025, SEQ ID NO: 1029, SEQ ID NO: 1033, SEQ ID NO: 1037, SEQ ID NO: 1041, SEQ ID NO: 1051, SEQ ID NO: 1055, SEQ ID NO: 1065, SEQ ID NO: 1069, SEQ ID NO: 1079, SEQ ID NO: 1083, SEQ ID NO: 1093, SEQ ID NO: 1097, SEQ ID NO: 1107, SEQ ID NO: 1111, SEQ ID NO: 1121, SEQ ID NO: 1125, SEQ ID NO: 1135, SEQ ID NO: 1139, SEQ ID NO: 1149, SEQ ID NO: 1153, SEQ ID NO: 1163, SEQ ID NO: 1167, SEQ ID NO: 1177, SEQ ID NO: 1181, SEQ ID NO: 1191, SEQ ID NO: 1195, SEQ ID NO: 1205, SEQ ID NO: 1209, SEQ ID NO: 1219, SEQ ID NO: 1223, SEQ ID NO: 1233, SEQ ID NO: 1237, SEQ ID NO: 1247, SEQ ID NO: 1251, SEQ ID NO: 1261, SEQ ID NO: 1265, SEQ ID NO: 1275, SEQ ID NO: 1279, SEQ ID NO: 1289, SEQ ID NO: 1293, SEQ ID NO: 1303, SEQ ID NO: 1307, SEQ ID NO: 1317, SEQ ID NO: 1321, SEQ ID NO: 1331, SEQ ID NO: 1335, SEQ ID NO: 1345, SEQ ID NO: 1349, SEQ ID NO: 1359, SEQ ID NO: 1363, SEQ ID NO: 1373, SEQ ID NO: 1377, SEQ ID NO: 1387, SEQ ID NO: 1391, SEQ ID NO: 1401, SEQ ID NO: 1405, SEQ ID NO: 1415, SEQ ID NO: 1419, SEQ ID NO: 1429, SEQ ID NO: 1433, SEQ ID NO: 1443, SEQ ID NO: 1447, SEQ ID NO: 1457, SEQ ID NO: 1461, SEQ ID NO: 1471, SEQ ID NO: 1475, SEQ ID NO: 1485, SEQ ID NO: 1489, SEQ ID NO: 1499, SEQ ID NO: 1503, SEQ ID NO: 1513, SEQ ID NO: 1517, SEQ ID NO: 1527, SEQ ID NO: 1531, SEQ ID NO: 1541, SEQ ID NO: 1545, SEQ ID NO: 1555, SEQ ID NO: 1559, SEQ ID NO: 1569, and SEQ ID NO: 1573; and a polypeptide having the amino acid sequence depicted in SEQ ID NO: 818; and a polypeptide comprising in the following order starting from the N-terminus:

a polypeptide having an amino acid sequence selected from the group consisting of SEQ ID NO: 7, SEQ ID NO: 17, SEQ ID NO: 27, SEQ ID NO: 37, SEQ ID NO: 47, SEQ ID NO: 57, SEQ ID NO: 67, SEQ ID NO: 77, SEQ ID NO: 87, SEQ ID NO: 97, SEQ ID NO: 107, SEQ ID NO: 117, SEQ ID NO: 127, SEQ ID NO: 137, SEQ ID NO: 147, SEQ ID NO: 157, SEQ ID NO: 167, SEQ ID NO: 177, SEQ ID NO: 187, SEQ ID NO: 197, SEQ ID NO: 207, SEQ ID NO: 217, SEQ ID NO: 227, SEQ ID NO: 237, SEQ ID NO: 247, SEQ ID NO: 257, SEQ ID NO: 267, SEQ ID NO: 277, SEQ ID NO: 287, SEQ ID NO: 297, SEQ ID NO: 307, SEQ ID NO: 317, SEQ ID NO: 327, SEQ ID NO: 337, SEQ ID NO: 347, SEQ ID NO: 357, SEQ ID NO: 367, SEQ ID NO: 377, SEQ ID NO: 387, SEQ ID NO: 397, SEQ ID NO: 407, SEQ ID NO: 417, SEQ ID NO: 427, SEQ ID NO: 437, SEQ ID NO: 447, SEQ ID NO: 457, SEQ ID NO: 467, SEQ ID NO: 477, SEQ ID NO: 487, SEQ ID NO: 497, SEQ ID NO: 507, SEQ ID NO: 517, SEQ ID NO: 527, SEQ ID NO: 537, SEQ ID NO: 547, SEQ ID NO: 557, SEQ ID NO: 567, SEQ ID NO: 577, SEQ ID NO: 587, SEQ ID NO: 597, SEQ ID NO: 607, SEQ ID NO: 617, SEQ ID NO: 627, SEQ ID NO: 637, SEQ ID NO: 647, SEQ ID NO: 657, SEQ ID NO: 667, SEQ ID NO: 677, SEQ ID NO: 687, SEQ ID NO: 697, SEQ ID NO: 707, SEQ ID NO: 717, SEQ ID NO: 727, SEQ ID NO: 737; SEQ ID NO: 920, SEQ ID NO: 924, SEQ ID NO: 928, SEQ ID NO: 932, SEQ ID NO: 936, SEQ ID NO: 940, SEQ ID NO: 944, SEQ ID NO: 948, SEQ ID NO: 952, SEQ ID NO: 956, SEQ ID NO: 960, SEQ ID NO: 964, SEQ ID NO: 968, SEQ ID NO: 972, SEQ ID NO: 976, SEQ ID NO: 980, SEQ ID NO: 984, SEQ ID NO: 988, SEQ ID NO: 992, SEQ ID NO: 996, SEQ ID NO: 1000, SEQ ID NO: 1004, SEQ ID NO: 1008, SEQ ID NO: 1012, SEQ ID NO: 1016, SEQ ID NO: 1020, SEQ ID NO: 1024, SEQ ID NO: 1028, SEQ ID NO: 1032, SEQ ID NO: 1036, SEQ ID NO: 1040, SEQ ID NO: 1050, SEQ ID NO: 1054, SEQ ID NO: 1064, SEQ ID NO: 1068, SEQ ID NO: 1078, SEQ ID NO: 1082, SEQ ID NO: 1092, SEQ ID NO: 1096, SEQ ID NO: 1106, SEQ ID NO: 1110, SEQ ID NO: 1120, SEQ ID NO: 1124, SEQ ID NO: 1134, SEQ ID NO: 1138, SEQ ID NO: 1148, SEQ ID NO: 1152, SEQ ID NO: 1162, SEQ ID NO: 1166, SEQ ID NO: 1176, SEQ ID NO: 1180, SEQ ID NO: 1190, SEQ ID NO: 1194, SEQ ID NO: 1204, SEQ ID NO: 1208, SEQ ID NO: 1218, SEQ ID NO: 1222, SEQ ID NO: 1232, SEQ ID NO: 1236, SEQ ID NO: 1246, SEQ ID NO: 1250, SEQ ID NO: 1260, SEQ ID NO: 1264, SEQ ID NO: 1274, SEQ ID NO: 1278, SEQ ID NO: 1288, SEQ ID NO: 1292, SEQ ID NO: 1302, SEQ ID NO: 1306, SEQ ID NO: 1316, SEQ ID NO: 1320, SEQ ID NO: 1330, SEQ ID NO: 1334, SEQ ID NO: 1344, SEQ ID NO: 1348, SEQ ID NO: 1358, SEQ ID NO: 1362, SEQ ID NO: 1372, SEQ ID NO: 1376, SEQ ID NO: 1386, SEQ ID NO: 1390, SEQ ID NO: 1400, SEQ ID NO: 1404, SEQ ID NO: 1414, SEQ ID NO: 1418, SEQ ID NO: 1428, SEQ ID NO: 1432, SEQ ID NO: 1442, SEQ ID NO: 1446, SEQ ID NO: 1456, SEQ ID NO: 1460, SEQ ID NO: 1470, SEQ ID NO: 1474, SEQ ID NO: 1484, SEQ ID NO: 1488, SEQ ID NO: 1498, SEQ ID NO: 1502, SEQ ID NO: 1512, SEQ ID NO: 1516, SEQ ID NO: 1526, SEQ ID NO: 1530, SEQ ID NO: 1540, SEQ ID NO: 1544, SEQ ID NO: 1554, SEQ ID NO: 1558, SEQ ID NO: 1568, and SEQ ID NO: 1572;

a peptide linker having the amino acid sequence depicted in SEQ ID NO: 777;

a polypeptide having an amino acid sequence selected from the group consisting of SEQ ID NO: 834, SEQ ID NO: 843, SEQ ID NO: 852, SEQ ID NO: 861, SEQ ID NO: 870, SEQ ID NO: 879, SEQ ID NO: 888, SEQ ID NO: 897, SEQ ID NO: 906, SEQ ID NO: 915, and SEQ ID NO: 918 followed by a serine residue at the C-terminus; and a polypeptide having the amino acid sequence depicted in SEQ ID NO: 819;

(f) a polypeptide comprising in the following order starting from the N-terminus:

a polypeptide having an amino acid sequence selected from the group consisting of SEQ ID NO: 9, SEQ ID NO: 19, SEQ ID NO: 29, SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 179, SEQ ID NO: 189, SEQ ID NO: 199, SEQ ID NO: 209, SEQ ID NO: 219, SEQ ID NO: 229, SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 319, SEQ ID NO: 329, SEQ ID NO: 339, SEQ ID NO: 349, SEQ ID NO: 359, SEQ ID NO: 369, SEQ ID NO: 379, SEQ ID NO: 389, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, SEQ ID NO: 509, SEQ ID NO: 519, SEQ ID NO: 529, SEQ ID NO: 539, SEQ ID NO: 549, SEQ ID NO: 559, SEQ ID NO: 569, SEQ ID NO: 579, SEQ ID NO: 589, SEQ ID NO: 599, SEQ ID NO: 609, SEQ ID NO: 619, SEQ ID NO: 629, SEQ ID NO: 639, SEQ ID NO: 649, SEQ ID NO: 659, SEQ ID NO: 669, SEQ ID NO: 679, SEQ ID NO: 689, SEQ ID NO: 699, SEQ ID NO: 709, SEQ ID NO: 719, SEQ ID NO: 729, SEQ ID NO: 739, SEQ ID NO: 922, SEQ ID NO: 926, SEQ ID NO: 930, SEQ ID NO: 934, SEQ ID NO: 938, SEQ ID NO: 942, SEQ ID NO: 946, SEQ ID NO: 950, SEQ ID NO: 954, SEQ ID NO: 958, SEQ ID NO: 962, SEQ ID NO: 966, SEQ ID NO: 970, SEQ ID NO: 974, SEQ ID NO: 978, SEQ ID NO: 982, SEQ ID NO: 986, SEQ ID NO: 990, SEQ ID NO: 994, SEQ ID NO: 998, SEQ ID NO: 1002, SEQ ID NO: 1006, SEQ ID NO: 1010, SEQ ID NO: 1014, SEQ ID NO: 1018, SEQ ID NO: 1022, SEQ ID NO: 1026, SEQ ID NO: 1030, SEQ ID NO: 1034, SEQ ID NO: 1038, SEQ ID NO: 1042, SEQ ID NO: 1052, SEQ ID NO: 1056, SEQ ID NO: 1066, SEQ ID NO: 1070, SEQ ID NO: 1080, SEQ ID NO: 1084, SEQ ID NO: 1094, SEQ ID NO: 1098, SEQ ID NO: 1108, SEQ ID NO: 1112, SEQ ID NO: 1122, SEQ ID NO: 1126, SEQ ID NO: 1136, SEQ ID NO: 1140, SEQ ID NO: 1150, SEQ ID NO: 1154, SEQ ID NO: 1164, SEQ ID NO: 1168, SEQ ID NO: 1178, SEQ ID NO: 1182, SEQ ID NO: 1192, SEQ ID NO: 1196, SEQ ID NO: 1206, SEQ ID NO: 1210, SEQ ID NO: 1220, SEQ ID NO: 1224, SEQ ID NO: 1234, SEQ ID NO: 1238, SEQ ID NO: 1248, SEQ ID NO: 1252, SEQ ID NO: 1262, SEQ ID NO: 1266, SEQ ID NO: 1276, SEQ ID NO: 1280, SEQ ID NO: 1290, SEQ ID NO: 1294, SEQ ID NO: 1304, SEQ ID NO: 1308, SEQ ID NO: 1318, SEQ ID NO: 1322, SEQ ID NO: 1332, SEQ ID NO: 1336, SEQ ID NO: 1346, SEQ ID NO: 1350, SEQ ID NO: 1360, SEQ ID NO: 1364, SEQ ID NO: 1374, SEQ ID NO: 1378, SEQ ID NO: 1388, SEQ ID NO: 1392, SEQ ID NO: 1402, SEQ ID NO: 1406, SEQ ID NO: 1416, SEQ ID NO: 1420, SEQ ID NO: 1430, SEQ ID NO: 1434, SEQ ID NO: 1444, SEQ ID NO: 1448, SEQ ID NO: 1458, SEQ ID NO: 1462, SEQ ID NO: 1472, SEQ ID NO: 1476, SEQ ID NO: 1486, SEQ ID NO: 1490, SEQ ID NO: 1500, SEQ ID NO: 1504, SEQ ID NO: 1514, SEQ ID NO: 1518, SEQ ID NO: 1528, SEQ ID NO: 1532, SEQ ID NO:

1542, SEQ ID NO: 1546, SEQ ID NO: 1556, SEQ ID NO: 1560, SEQ ID NO: 1570, and SEQ ID NO: 1574;

a peptide linker having an amino acid sequence selected from the group consisting of SEQ ID NOs: 770-778;

a polypeptide having an amino acid sequence selected from the group consisting of SEQ ID NO: 835, SEQ ID NO: 844, SEQ ID NO: 853, SEQ ID NO: 862, SEQ ID NO: 871, SEQ ID NO: 880, SEQ ID NO: 889, SEQ ID NO: 898, SEQ ID NO: 907, SEQ ID NO: 916, and SEQ ID NO: 919;

a polypeptide having the amino acid sequence depicted in SEQ ID NO: 820; and a polypeptide having the amino acid sequence depicted in SEQ ID NO: 821;

(g) a polypeptide comprising in the following order starting from the N-terminus:

a polypeptide having an amino acid sequence selected from the group consisting of SEQ ID NO: 9, SEQ ID NO: 19, SEQ ID NO: 29, SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 179, SEQ ID NO: 189, SEQ ID NO: 199, SEQ ID NO: 209, SEQ ID NO: 219, SEQ ID NO: 229, SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 319, SEQ ID NO: 329, SEQ ID NO: 339, SEQ ID NO: 349, SEQ ID NO: 359, SEQ ID NO: 369, SEQ ID NO: 379, SEQ ID NO: 389, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, SEQ ID NO: 509, SEQ ID NO: 519, SEQ ID NO: 529, SEQ ID NO: 539, SEQ ID NO: 549, SEQ ID NO: 559, SEQ ID NO: 569, SEQ ID NO: 579, SEQ ID NO: 589, SEQ ID NO: 599, SEQ ID NO: 609, SEQ ID NO: 619, SEQ ID NO: 629, SEQ ID NO: 639, SEQ ID NO: 649, SEQ ID NO: 659, SEQ ID NO: 669, SEQ ID NO: 679, SEQ ID NO: 689, SEQ ID NO: 699, SEQ ID NO: 709, SEQ ID NO: 719, SEQ ID NO: 729, SEQ ID NO: 739, SEQ ID NO: 922, SEQ ID NO: 926, SEQ ID NO: 930, SEQ ID NO: 934, SEQ ID NO: 938, SEQ ID NO: 942, SEQ ID NO: 946, SEQ ID NO: 950, SEQ ID NO: 954, SEQ ID NO: 958, SEQ ID NO: 962, SEQ ID NO: 966, SEQ ID NO: 970, SEQ ID NO: 974, SEQ ID NO: 978, SEQ ID NO: 982, SEQ ID NO: 986, SEQ ID NO: 990, SEQ ID NO: 994, SEQ ID NO: 998, SEQ ID NO: 1002, SEQ ID NO: 1006, SEQ ID NO: 1010, SEQ ID NO: 1014, SEQ ID NO: 1018, SEQ ID NO: 1022, SEQ ID NO: 1026, SEQ ID NO: 1030, SEQ ID NO: 1034, SEQ ID NO: 1038, SEQ ID NO: 1042, SEQ ID NO: 1052, SEQ ID NO: 1056, SEQ ID NO: 1066, SEQ ID NO: 1070, SEQ ID NO: 1080, SEQ ID NO: 1084, SEQ ID NO: 1094, SEQ ID NO: 1098, SEQ ID NO: 1108, SEQ ID NO: 1112, SEQ ID NO: 1122, SEQ ID NO: 1126, SEQ ID NO: 1136, SEQ ID NO: 1140, SEQ ID NO: 1150, SEQ ID NO: 1154, SEQ ID NO: 1164, SEQ ID NO: 1168, SEQ ID NO: 1178, SEQ ID NO: 1182, SEQ ID NO: 1192, SEQ ID NO: 1196, SEQ ID NO: 1206, SEQ ID NO: 1210, SEQ ID NO: 1220, SEQ ID NO: 1224, SEQ ID NO: 1234, SEQ ID NO: 1238, SEQ ID NO: 1248, SEQ ID NO: 1252, SEQ ID NO: 1262, SEQ ID NO: 1266, SEQ ID NO: 1276, SEQ ID NO: 1280, SEQ ID NO: 1290, SEQ ID NO: 1294, SEQ ID NO: 1304, SEQ ID NO: 1308, SEQ ID NO: 1318, SEQ ID NO: 1322, SEQ ID NO: 1332, SEQ ID NO: 1336, SEQ ID NO: 1346, SEQ ID NO: 1350, SEQ ID NO: 1360, SEQ ID NO: 1364, SEQ ID NO: 1374, SEQ ID NO: 1378, SEQ ID NO: 1388, SEQ ID NO: 1392, SEQ ID NO: 1402, SEQ ID NO: 1406, SEQ ID NO: 1416, SEQ ID NO: 1420, SEQ ID NO: 1430, SEQ ID NO: 1434, SEQ ID NO: 1444, SEQ ID NO: 1448, SEQ ID NO: 1458, SEQ ID NO: 1462, SEQ ID NO: 1472, SEQ ID NO: 1476, SEQ ID NO: 1486, SEQ ID NO: 1490, SEQ ID NO: 1500, SEQ ID NO: 1504, SEQ ID NO: 1514, SEQ ID NO: 1518, SEQ ID NO: 1528, SEQ ID NO: 1532, SEQ ID NO: 1542, SEQ ID NO: 1546, SEQ ID NO: 1556, SEQ ID NO: 1560, SEQ ID NO: 1570, and SEQ ID NO: 1574; and a polypeptide having the amino acid sequence depicted in SEQ ID NO: 822; and a polypeptide comprising in the following order starting from the N-terminus:

a polypeptide having an amino acid sequence selected from the group consisting of SEQ ID NO: 835, SEQ ID NO: 844, SEQ ID NO: 853, SEQ ID NO: 862, SEQ ID NO: 871, SEQ ID NO: 880, SEQ ID NO: 889, SEQ ID NO: 898, SEQ ID NO: 907, SEQ ID NO: 916, and SEQ ID NO: 919; and a polypeptide having the amino acid sequence depicted in SEQ ID NO: 823;

(h) a polypeptide comprising in the following order starting from the N-terminus:

a polypeptide having an amino acid sequence selected from the group consisting of SEQ ID NO: 9, SEQ ID NO: 19, SEQ ID NO: 29, SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 179, SEQ ID NO: 189, SEQ ID NO: 199, SEQ ID NO: 209, SEQ ID NO: 219, SEQ ID NO: 229, SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 319, SEQ ID NO: 329, SEQ ID NO: 339, SEQ ID NO: 349, SEQ ID NO: 359, SEQ ID NO: 369, SEQ ID NO: 379, SEQ ID NO: 389, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, SEQ ID NO: 509, SEQ ID NO: 519, SEQ ID NO: 529, SEQ ID NO: 539, SEQ ID NO: 549, SEQ ID NO: 559, SEQ ID NO: 569, SEQ ID NO: 579, SEQ ID NO: 589, SEQ ID NO: 599, SEQ ID NO: 609, SEQ ID NO: 619, SEQ ID NO: 629, SEQ ID NO: 639, SEQ ID NO: 649, SEQ ID NO: 659, SEQ ID NO: 669, SEQ ID NO: 679, SEQ ID NO: 689, SEQ ID NO: 699, SEQ ID NO: 709, SEQ ID NO: 719, SEQ ID NO: 729, SEQ ID NO: 739, SEQ ID NO: 922, SEQ ID NO: 926, SEQ ID NO: 930, SEQ ID NO: 934, SEQ ID NO: 938, SEQ ID NO: 942, SEQ ID NO: 946, SEQ ID NO: 950, SEQ ID NO: 954, SEQ ID NO: 958, SEQ ID NO: 962, SEQ ID NO: 966, SEQ ID NO: 970, SEQ ID NO: 974, SEQ ID NO: 978, SEQ ID NO: 982, SEQ ID NO: 986, SEQ ID NO: 990, SEQ ID NO: 994, SEQ ID NO: 998, SEQ ID NO: 1002, SEQ ID NO: 1006, SEQ ID NO: 1010, SEQ ID NO: 1014, SEQ ID NO: 1018, SEQ ID NO: 1022, SEQ ID NO: 1026, SEQ ID NO: 1030, SEQ ID NO: 1034, SEQ ID NO: 1038, SEQ ID NO: 1042, SEQ ID NO: 1052, SEQ ID NO: 1056, SEQ ID NO: 1066, SEQ ID NO: 1070, SEQ ID NO: 1080, SEQ ID NO: 1084, SEQ ID NO: 1094, SEQ ID NO: 1098, SEQ ID NO: 1108, SEQ ID NO: 1112, SEQ ID NO: 1122, SEQ ID NO: 1126, SEQ ID NO: 1136, SEQ ID NO: 1140, SEQ ID NO: 1150, SEQ ID NO: 1154, SEQ ID NO: 1164, SEQ ID NO: 1168, SEQ ID NO: 1178, SEQ ID NO: 1182, SEQ ID NO: 1192, SEQ ID NO: 1196, SEQ ID NO: 1206, SEQ ID NO: 1210, SEQ ID NO: 1220, SEQ ID NO: 1224, SEQ ID NO: 1234, SEQ ID NO: 1238, SEQ ID NO: 1248, SEQ ID NO: 1252, SEQ ID NO: 1262, SEQ ID NO: 1266, SEQ ID NO: 1276, SEQ ID NO: 1280, SEQ ID NO: 1290, SEQ ID NO: 1294, SEQ ID NO: 1304, SEQ ID NO: 1308, SEQ ID NO: 1318, SEQ ID NO: 1322, SEQ ID NO: 1332, SEQ ID NO: 1336, SEQ ID NO: 1346, SEQ ID NO: 1350, SEQ ID NO: 1360, SEQ ID NO: 1364, SEQ ID NO: 1374, SEQ ID NO: 1378, SEQ ID NO: 1388, SEQ ID NO: 1392, SEQ ID NO: 1402, SEQ ID NO: 1406, SEQ ID NO: 1416, SEQ ID NO: 1420, SEQ ID NO: 1430, SEQ ID NO: 1434, SEQ ID NO: 1444, SEQ ID NO: 1448, SEQ ID NO: 1458, SEQ ID NO: 1462, SEQ ID NO: 1472, SEQ ID NO: 1476, SEQ ID NO: 1486, SEQ ID NO: 1490, SEQ ID NO: 1500, SEQ ID NO: 1504, SEQ ID NO: 1514, SEQ ID NO: 1518, SEQ ID NO: 1528, SEQ ID NO: 1532, SEQ ID NO: 1542, SEQ ID NO: 1546, SEQ ID NO: 1556, SEQ ID NO: 1560, SEQ ID NO: 1570, and SEQ ID NO: 1574; and a polypeptide having the amino acid sequence depicted in SEQ ID NO: 824; and a polypeptide comprising in the following order starting from the N-terminus:

a polypeptide having an amino acid sequence selected from the group consisting of SEQ ID NO: 835, SEQ ID NO: 844, SEQ ID NO: 853, SEQ ID NO: 862, SEQ ID NO: 871, SEQ ID NO: 880, SEQ ID NO: 889, SEQ ID NO: 898, SEQ ID NO: 907, SEQ ID NO: 916, and SEQ ID NO: 919; and a polypeptide having the amino acid sequence depicted in SEQ ID NO: 825; or (i) a polypeptide comprising in the following order starting from the N-terminus:

a polypeptide having an amino acid sequence selected from the group consisting of SEQ ID NO: 9, SEQ ID NO: 19, SEQ ID NO: 29, SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 179, SEQ ID NO: 189, SEQ ID NO: 199, SEQ ID NO: 209, SEQ ID NO: 219, SEQ ID NO: 229, SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 319, SEQ ID NO: 329, SEQ ID NO: 339, SEQ ID NO: 349, SEQ ID NO: 359, SEQ ID NO: 369, SEQ ID NO: 379, SEQ ID NO: 389, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, SEQ ID NO: 509, SEQ ID NO: 519, SEQ ID NO: 529, SEQ ID NO: 539, SEQ ID NO: 549, SEQ ID NO: 559, SEQ ID NO: 569, SEQ ID NO: 579, SEQ ID NO: 589, SEQ ID NO: 599, SEQ ID NO: 609, SEQ ID NO: 619, SEQ ID NO: 629, SEQ ID NO: 639, SEQ ID NO: 649, SEQ ID NO: 659, SEQ ID NO: 669, SEQ ID NO: 679, SEQ ID NO: 689, SEQ ID NO: 699, SEQ ID NO: 709, SEQ ID NO: 719, SEQ ID NO: 729, SEQ ID NO: 739, SEQ ID NO: 922, SEQ ID NO: 926, SEQ ID NO: 930, SEQ ID NO: 934, SEQ ID NO: 938, SEQ ID NO: 942, SEQ ID NO: 946, SEQ ID NO: 950, SEQ ID NO: 954, SEQ ID NO: 958, SEQ ID NO: 962, SEQ ID NO: 966, SEQ ID NO: 970, SEQ ID NO: 974, SEQ ID NO: 978, SEQ ID NO: 982, SEQ ID NO: 986, SEQ ID NO: 990, SEQ ID NO: 994, SEQ ID NO: 998, SEQ ID NO: 1002, SEQ ID NO: 1006, SEQ ID NO: 1010, SEQ ID NO: 1014, SEQ ID NO: 1018, SEQ ID NO: 1022, SEQ ID NO: 1026, SEQ ID NO: 1030, SEQ ID NO: 1034, SEQ ID NO: 1038, SEQ ID NO: 1042, SEQ ID NO: 1052, SEQ ID NO: 1056, SEQ ID NO: 1066, SEQ ID NO: 1070, SEQ ID NO: 1080, SEQ ID NO: 1084, SEQ ID NO: 1094, SEQ ID NO: 1098, SEQ ID NO: 1108, SEQ ID NO: 1112, SEQ ID NO: 1122, SEQ ID NO: 1126, SEQ ID NO: 1136, SEQ ID NO: 1140, SEQ ID NO: 1150, SEQ ID NO: 1154, SEQ ID NO: 1164, SEQ ID NO: 1168, SEQ ID NO: 1178, SEQ ID NO: 1182, SEQ ID NO: 1192, SEQ ID NO: 1196, SEQ ID NO: 1206, SEQ ID NO: 1210, SEQ ID NO: 1220, SEQ ID NO: 1224, SEQ ID NO: 1234, SEQ ID NO: 1238, SEQ ID NO: 1248, SEQ ID NO: 1252, SEQ ID NO: 1262, SEQ ID NO: 1266, SEQ ID NO: 1276, SEQ ID NO: 1280, SEQ ID NO: 1290, SEQ ID NO: 1294, SEQ ID NO: 1304, SEQ ID NO: 1308, SEQ ID NO: 1318, SEQ ID NO: 1322, SEQ ID NO: 1332, SEQ ID NO: 1336, SEQ ID NO: 1346, SEQ ID NO: 1350, SEQ ID NO: 1360, SEQ ID NO: 1364, SEQ ID NO: 1374, SEQ ID NO: 1378, SEQ ID NO: 1388, SEQ ID NO: 1392, SEQ ID NO: 1402, SEQ ID NO: 1406, SEQ ID NO: 1416, SEQ ID NO: 1420, SEQ ID NO: 1430, SEQ ID NO: 1434, SEQ ID NO: 1444, SEQ ID NO: 1448, SEQ ID NO: 1458, SEQ ID NO: 1462, SEQ ID NO: 1472, SEQ ID NO: 1476, SEQ ID NO: 1486, SEQ ID NO: 1490, SEQ ID NO: 1500, SEQ ID NO: 1504, SEQ ID NO: 1514, SEQ ID NO: 1518, SEQ ID NO: 1528, SEQ ID NO: 1532, SEQ ID NO: 1542, SEQ ID NO: 1546, SEQ ID NO: 1556, SEQ ID NO: 1560, SEQ ID NO: 1570, and SEQ ID NO: 1574;

a peptide linker having an amino acid sequence selected from the group consisting of SEQ ID NOs: 770-778;

a polypeptide having an amino acid sequence selected from the group consisting of SEQ ID NO: 835, SEQ ID NO: 844, SEQ ID NO: 853, SEQ ID NO: 862, SEQ ID NO: 871, SEQ ID NO: 880, SEQ ID NO: 889, SEQ ID NO: 898, SEQ ID NO: 907, SEQ ID NO: 916, and SEQ ID NO: 919; and a polypeptide having the amino acid sequence depicted in SEQ ID NO: 826.

As described above, several preferred antibody constructs of the invention are modified by fusion with another moiety such as albumin or albumin variants. If these fusion constructs are characterized for their properties, such as in particular their target affinity or cytotoxic activity, the skilled person will be aware that similar fusion constructs or unmodified bispecific antibody constructs can be expected to have similar (or possibly even better) properties. For example, if a bispecific antibody construct fused with albumin has an appreciable or desirable cytotoxic activity or target affinity, it can be expected that the same/similar or even a higher cytotoxic activity/target affinity will be observed for the same construct w/o albumin.

According to another preferred embodiment, the bispecific antibody construct of the invention comprises (in addition to the two binding domains) a third domain which comprises two polypeptide monomers, each comprising a hinge, a CH2 and a CH3 domain, wherein said two polypeptides (or polypeptide monomers) are fused to each other via a peptide linker. Preferably, said third domain comprises in an N- to C-terminal order: hinge-CH2-CH3-linker-hinge-CH2-CH3. Preferred amino acid sequences for said third domain are depicted in SEQ ID NOs: 1856- 1863. Each of said polypeptide monomers preferably has an amino acid sequence that is selected from the group consisting of SEQ ID NOs: 1848-1855, or that is at least 90% identical to those sequences. In another preferred embodiment, the first and second binding domains of the bispecific antibody construct of the invention are fused to the third domain via a peptide linker which is for example selected from the group consisting of SEQ ID NOs: 770, 771, 773, 774, 775, 777 and 778.

In line with the present invention, a "hinge" is an IgG hinge region. This region can be identified by analogy using the Kabat numbering, see Kabat positions 223-243. In line with the above, the minimal requirement for a "hinge" are the amino acid residues corresponding to the IgG1 sequence stretch of D231 to P243 according to the Kabat numbering. The terms CH2 and CH3 refer to the immunoglobulin heavy chain constant regions 2 and 3. These regions can as well be identified by analogy using the Kabat numbering, see Kabat positions 244-360 for CH2 and Kabat positions 361-478 for CH3. It is understood that there is some variation between the immunoglobulins in terms of their IgG1 Fc region, IgG2 Fc region, IgG3 Fc region, IgG4 Fc region, IgM Fc region, IgA Fc region, IgD Fc region and IgE Fc region (see, e.g., Padlan, Molecular Immunology, 31(3), 169-217 (1993)). The term Fc monomer refers to the last two heavy chain constant regions of IgA, IgD, and IgG, and the last three heavy chain constant regions of IgE and IgM. The Fc monomer can also include the flexible hinge N-terminal to these domains. For IgA and IgM, the Fc monomer may include the J chain. For IgG, the Fc portion comprises immunoglobulin domains CH2 and CH3 and the hinge between the first two domains and CH2. Although the boundaries of the Fc portion of an immunoglobulin may vary, an example for a human IgG heavy chain Fc portion comprising a functional hinge, CH2 and CH3 domain can be defined e.g. to comprise residues D231 (of the hinge domain) to P476 (of the C-terminus of the CH3 domain), or D231 to L476, respectively, for IgG4, wherein the numbering is according to Kabat.

The antibody construct of the invention may hence comprise in an N- to C-terminal order:

(a) the first binding domain;

(b) a peptide linker having an amino acid sequence selected from the group consisting of SEQ ID NOs: 771, 777, and 778;

(c) the second binding domain;

(d) a peptide linker having an amino acid sequence selected from the group consisting of SEQ ID NOs: 770, 771, 773, 774, 775, 777 and 778;

(e) the first polypeptide monomer of the third domain (comprising a hinge, a CH2 and a CH3 domain);

(f) a peptide linker having an amino acid sequence selected from the group consisting of SEQ ID NOs: 1865, 1866, 1867, and 1868; and (g) the second polypeptide monomer of the third domain (comprising a hinge, a CH2 and a CH3 domain).

It is also preferred that the antibody construct of the invention comprises in an N- to C-terminal order:

the first binding domain having an amino acid sequence selected from the group consisting of SEQ ID NO: 9, SEQ ID NO: 19, SEQ ID NO: 29, SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 179, SEQ ID NO: 189, SEQ ID NO: 199, SEQ ID NO: 209, SEQ ID NO: 219, SEQ ID NO: 229, SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 319, SEQ ID NO: 329, SEQ ID NO: 339, SEQ ID NO: 349, SEQ ID NO: 359, SEQ ID NO: 369, SEQ ID NO: 379, SEQ ID NO: 389, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, SEQ ID NO: 509, SEQ ID NO: 519, SEQ ID NO: 529, SEQ ID NO: 539, SEQ ID NO: 549, SEQ ID NO: 559, SEQ ID NO: 569, SEQ ID NO: 579, SEQ ID NO: 589, SEQ ID NO: 599, SEQ ID NO: 609, SEQ ID NO: 619, SEQ ID NO: 629, SEQ ID NO: 639, SEQ ID NO: 649, SEQ ID NO: 659, SEQ ID NO: 669, SEQ ID NO: 679, SEQ ID NO: 689, SEQ ID NO: 699, SEQ ID NO: 709, SEQ ID NO: 719, SEQ ID NO: 729, SEQ ID NO: 739, SEQ ID NO: 922, SEQ ID NO: 926, SEQ ID NO: 930, SEQ ID NO: 934, SEQ ID NO: 938, SEQ ID NO: 942, SEQ ID NO: 946, SEQ ID NO: 950, SEQ ID NO: 954, SEQ ID NO: 958, SEQ ID NO: 962, SEQ ID NO: 966, SEQ ID NO: 970, SEQ ID NO: 974, SEQ ID NO: 978, SEQ ID NO: 982, SEQ ID NO: 986, SEQ ID NO: 990, SEQ ID NO: 994, SEQ ID NO: 998, SEQ ID NO: 1002, SEQ ID NO: 1006, SEQ ID NO: 1010, SEQ ID NO: 1014, SEQ ID NO: 1018, SEQ ID NO: 1022, SEQ ID NO: 1026, SEQ ID NO: 1030, SEQ ID NO: 1034, SEQ ID NO: 1038, SEQ ID NO: 1042, SEQ ID NO: 1052, SEQ ID NO: 1056, SEQ ID NO: 1066, SEQ ID NO: 1070, SEQ ID NO: 1080, SEQ ID NO: 1084, SEQ ID NO: 1094, SEQ ID NO: 1098, SEQ ID NO: 1108, SEQ ID NO: 1112, SEQ ID NO: 1122, SEQ ID NO: 1126, SEQ ID NO: 1136, SEQ ID NO: 1140, SEQ ID NO: 1150, SEQ ID NO: 1154, SEQ ID NO: 1164, SEQ ID NO: 1168, SEQ ID NO: 1178, SEQ ID NO: 1182, SEQ ID NO: 1192, SEQ ID NO: 1196, SEQ ID NO: 1206, SEQ ID NO: 1210, SEQ ID NO: 1220, SEQ ID NO: 1224, SEQ ID NO: 1234, SEQ ID NO: 1238, SEQ ID NO: 1248, SEQ ID NO: 1252, SEQ ID NO: 1262, SEQ ID NO: 1266, SEQ ID NO: 1276, SEQ ID NO: 1280, SEQ ID NO: 1290, SEQ ID NO: 1294, SEQ ID NO: 1304, SEQ ID NO: 1308, SEQ ID NO: 1318, SEQ ID NO: 1322, SEQ ID NO: 1332, SEQ ID NO: 1336, SEQ ID NO: 1346, SEQ ID NO: 1350, SEQ ID NO: 1360, SEQ ID NO: 1364, SEQ ID NO: 1374, SEQ ID NO: 1378, SEQ ID NO: 1388, SEQ ID NO: 1392, SEQ ID NO: 1402, SEQ ID NO: 1406, SEQ ID NO: 1416, SEQ ID NO: 1420, SEQ ID NO: 1430, SEQ ID NO: 1434, SEQ ID NO: 1444, SEQ ID NO: 1448, SEQ ID NO: 1458, SEQ ID NO: 1462, SEQ ID NO: 1472, SEQ ID NO: 1476, SEQ ID NO: 1486, SEQ ID NO: 1490, SEQ ID NO: 1500, SEQ ID NO: 1504, SEQ ID NO: 1514, SEQ ID NO: 1518, SEQ ID NO: 1528, SEQ ID NO: 1532, SEQ ID NO: 1542, SEQ ID NO: 1546, SEQ ID NO: 1556, SEQ ID NO: 1560, SEQ ID NO: 1570, and SEQ ID NO: 1574;

a peptide linker having an amino acid sequence selected from the group consisting of SEQ ID NOs: 771, 777, and 778;

the second binding domain having an amino acid sequence selected from the group consisting of SEQ ID NO: 835, SEQ ID NO: 844, SEQ ID NO: 853, SEQ ID NO: 862, SEQ ID NO: 871, SEQ ID NO: 880, SEQ ID NO: 889, SEQ ID NO: 898, SEQ ID NO: 907, SEQ ID NO: 916, and SEQ ID NO: 919;

a peptide linker having an amino acid sequence selected from the group consisting of SEQ ID NOs: 770, 771, 773, 774, 775, 777 and 778; and the third domain having an amino acid sequence selected from the group consisting of SEQ ID NOs: 1856-1863.

Hence, in a preferred embodiment, the antibody construct of the present invention comprises or consists of a polypeptide selected from the group consisting of those depicted in SEQ ID NOs: 1576-1847. Preferred are those polypeptides selected from the group consisting of those depicted in SEQ ID NO: 1696, SEQ ID NO: 1702, SEQ ID NO: 1710, SEQ ID NO: 1714, SEQ ID NO: 1716, SEQ ID NO: 1720, SEQ ID NO: 1722, SEQ ID NO: 1724, SEQ ID NO: 1726, SEQ ID NO: 1728, SEQ ID NO: 1738, SEQ ID NO: 1740, SEQ ID NO: 1742, SEQ ID NO: 1750, and SEQ ID NO: 1752.

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidazoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidazole and tetranitromethane are used to form O-acetyl tyrosyl species and 3-nitro derivatives, respectively. Tyrosyl residues are iodinated using $^{125}I$ or $^{131}I$ to prepare labeled proteins for use in radioimmunoassay, the chloramine T method described above being suitable.

Carboxyl side groups (aspartyl or glutamyl) are selectively modified by reaction with carbodiimides (R'—N═C═N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates as described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are also contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:

a) isotopic labels, which may be radioactive or heavy isotopes, such as radioisotopes or radionuclides (e.g., $^{3}H$, $^{14}C$, $^{15}N$, $^{35}S$, $^{89}Zr$, $^{90}Y$, $^{99}Tc$, $^{111}In$, $^{125}I$, $^{131}I$)
b) magnetic labels (e.g., magnetic particles)
c) redox active moieties
d) optical dyes (including, but not limited to, chromophores, phosphors and fluorophores) such as fluorescent groups (e.g., FITC, rhodamine, lanthanide phosphors), chemiluminescent groups, and fluorophores which can be either "small molecule" fluores or proteinaceous fluores
e) enzymatic groups (e.g. horseradish peroxidase, β-galactosidase, luciferase, alkaline phosphatase)
f) biotinylated groups
g) predetermined polypeptide epitopes recognized by a secondary reporter (e.g., leucine zipper pair sequences, binding sites for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, OR), FITC, Rhodamine, and Texas Red (Pierce, Rockford, IL), Cy5, Cy5.5, Cy7 (Amersham Life Science, Pittsburgh, PA). Suitable optical dyes, including fluorophores, are described in Molecular Probes Handbook by Richard P. Haugland.

Suitable proteinaceous fluorescent labels also include, but are not limited to, green fluorescent protein, including a *Renilla, Ptilosarcus*, or *Aequorea* species of GFP (Chalfie et al., 1994, Science 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, Biotechniques 24:462-471; Heim et al., 1996, Curr. Biol. 6:178-182), enhanced yellow fluorescent protein (EYFP, Clontech Laboratories, Inc.), luciferase (Ichiki et al., 1993, J. Immunol. 150:5408-5417), β galactosidase (Nolan et al., 1988, Proc. Natl. Acad. Sci. U.S.A. 85:2603-2607) and *Renilla* (WO92/15673, WO95/07463, WO98/14605, WO98/26277, WO99/49019, U.S. Pat. Nos. 5,292,658; 5,418,155; 5,683,888; 5,741,668; 5,777,079; 5,804,387; 5,874,304; 5,876,995; 5,925,558).

Leucine zipper domains are peptides that promote oligomerization of the proteins in which they are found.

Leucine zippers were originally identified in several DNA-binding proteins (Landschulz et al., 1988, Science 240: 1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, FEBS Letters 344:191. The use of a modified leucine zipper that allows for stable trimerization of a heterologous protein fused thereto is described in Fanslow et al., 1994, Semin. Immunol. 6:267-78. In one approach, recombinant fusion proteins comprising a CD70 antibody fragment or derivative fused to a leucine zipper peptide are expressed in suitable host cells, and the soluble oligomeric CD70 antibody fragments or derivatives that form are recovered from the culture supernatant.

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibody constructs characterized by the identified CDRs are preferred to comprise a His-tag domain, which is generally known as a repeat of consecutive His residues in the amino acid sequence of a molecule, preferably of five, and more preferably of six His residues (hexa-histidine). The His-tag may be located e.g. at the N- or C-terminus of the antibody construct, preferably it is located at the C-terminus. Most preferably, a hexa-histidine tag (HHHHHH, see SEQ ID NO: 779) is linked via peptide bond to the C-terminus of the antibody construct according to the invention.

The first binding domain of the antibody construct of the present invention binds to human CD70 on the surface of a target cell. The preferred amino acid sequence of human CD70 is represented by SEQ ID NO: 741. It is understood that the term "on the surface", in the context of the present invention, means that the binding domain specifically binds to an epitope comprised within the CD70 extracellular domain (CD70 ECD). The first binding domain according to the invention hence preferably binds to CD70 when it is expressed by naturally expressing cells or cell lines, and/or by cells or cell lines transformed or (stably/transiently) transfected with CD70. In a preferred embodiment the first binding domain also binds to CD70 when CD70 is used as a "target" or "ligand" molecule in an in vitro binding assay such as BIAcore™, i.e., surface plasmon resonance, or Scatchard. The "target cell" can be any prokaryotic or eukaryotic cell expressing CD70 on its surface; preferably the target cell is a cell that is part of the human or animal body, such as a specific cancer cell being selected e.g. from the group consisting of renal, lung, pancreatic, ovarian, breast, colon, or head and neck cancer, melanoma, Kaposi's Sarcoma, embryonal carcinoma, brain tumor, leukemia or lymphoma.

The term "CD70 ECD" refers to a form of CD70 which is essentially free of transmembrane and cytoplasmic domains of CD70. It will be understood by the skilled artisan that the transmembrane domain identified for the CD70 polypeptide of the present invention is identified pursuant to criteria routinely employed in the art for identifying that type of hydrophobic domain. The exact boundaries of a transmembrane domain may vary but most likely by no more than about 5 amino acids at either end of the domain specifically mentioned herein. A preferred human CD70 ECD is shown in SEQ ID NO: 742.

The affinity of the first binding domain for human CD70 is preferably ≤20 nM or ≤15 nM, more preferably ≤10 nM, even more preferably ≤5 nM, even more preferably ≤2 nM, even more preferably ≤1 nM, even more preferably ≤0.6 nM, even more preferably ≤0.5 nM, and most preferably ≤0.4 nM. The affinity can be measured for example in a BIAcore™ surface plasmon resonance assay or in a Scatchard assay, e.g. as described in the Examples. Other methods of determining the affinity are also well-known to the skilled person.

T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha (α) and beta (β) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors The CD3 receptor complex is a protein complex and is composed of four chains. In mammals, the complex contains a CD3γ (gamma) chain, a CD3δ (delta) chain, and two CD3ε (epsilon) chains. These chains associate with the T cell receptor (TCR) and the so-called ζ (zeta) chain to form the T cell receptor CD3 complex and to generate an activation signal in T lymphocytes. The CD3γ (gamma), CD3δ (delta), and CD3ε (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3E gene which resides on chromosome 11. The most preferred epitope of CD3 epsilon is comprised within amino acid residues 1-27 of the human CD3 epsilon extracellular domain.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

Cytotoxicity mediated by CD70×CD3 bispecific antibody constructs can be measured in various ways. See Examples 8.1 to 8.7. Effector cells can be e.g. stimulated enriched (human) CD8 positive T cells or unstimulated (human) peripheral blood mononuclear cells (PBMC). If the target cells are of macaque origin or express or are transfected with macaque CD70, the effector cells should also be of macaque origin such as a macaque T cell line, e.g. 4119LnPx. The target cells should express (at least the extracellular domain of) CD70, e.g. human or macaque CD70. Target cells can be a cell line (such as CHO) which is stably or transiently transfected with CD70, e.g. human or macaque CD70. Alternatively, the target cells can be a CD70 positive natural expresser cell line, such as the human ovarian carcinoma cell line OVCAR 8. Usually EC50 values are expected to be lower with target cell lines expressing higher levels of CD70 on the cell surface. The effector to target cell (E:T) ratio is usually about 10:1, but can also vary. Cytotoxic activity of CD70×CD3 bispecific antibody constructs can be measured in a 51-chromium release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by CD70×CD3 bispecific antibody constructs of the present invention is preferably measured in a cell-based cytotoxicity assay. It may also be measured in a 51-chromium release assay. It is represented by the EC50 value, which corresponds to the half maximal effective concentration (concentration of the antibody construct which induces a cytotoxic response halfway between the baseline and maximum). Preferably, the EC50 value of the CD70×CD3 bispecific antibody constructs is ≤10.000 pM or ≤5000 pM, more preferably ≤4000 pM or ≤3000 pM, even more preferably ≤2000 pM or ≤1000 pM, even more preferably ≤500 pM or ≤400 pM, even more preferably ≤300 pM or ≤200 pM, even more preferably ≤100 pM or ≤50 pM, even more preferably ≤20 pM or ≤10 pM, and most preferably ≤5 pM or ≤2 pM or ≤1 pM, or even ≤0.5 pM or ≤0.2 pM or ≤0.1 pM.

The above given EC50 values can be measured in different assays. The skilled person is aware that an EC50 value can be expected to be lower when stimulated/enriched CD8+ T cells are used as effector cells, compared with unstimulated PBMC. It can furthermore be expected that the EC50 values are lower when the target cells express a high number of the target antigen compared with a low target expression rat. For example, when stimulated/enriched human CD8+ T cells are used as effector cells (and either CD70 transfected cells such as CHO cells or a CD70 positive cell line are used as target cells), the EC50 value of the CD70×CD3 bispecific antibody construct is preferably ≤1000 pM, more preferably ≤500 pM, even more preferably ≤250 pM, even more preferably ≤100 pM, even more preferably ≤50 pM, even more preferably ≤10 pM, and most preferably ≤5 pM or ≤2 pM or ≤1 pM. When human PBMCs are used as effector cells, the EC50 value of the CD70×CD3 bispecific antibody construct is preferably ≤10.000 pM or ≤5000 pM or ≤4000 pM (in particular when the target cells are a CD70 positive cell line), more preferably ≤2000 pM (in particular when the target cells are CD70 transfected cells such as CHO cells), more preferably ≤1000 pM or ≤500 pM, even more preferably ≤200 pM, even more preferably ≤150 pM, even more preferably ≤100 pM, and most preferably ≤50 pM or ≤20 pM, or lower. When a macaque T cell line such as LnPx4119 is used as effector cells, and a macaque CD70 transfected cell line such as CHO cells is used as target cell line, the EC50 value of the CD70×CD3 bispecific antibody construct is preferably ≤2000 pM or ≤1500 pM, more preferably ≤1000 pM or ≤500 pM, even more preferably ≤300 pM or ≤250 pM, even more preferably ≤100 pM, and most preferably ≤50 pM or ≤20 pM, or lower, such as ≤10 pM, ≤5 pM, ≤1 pM, or ≤0.5 pM.

Preferably, the CD70×CD3 bispecific antibody constructs of the present invention do not induce/mediate lysis or do not essentially induce/mediate lysis of CD70 negative cells such as CHO cells. The term "do not induce lysis", "do not essentially induce lysis", "do not mediate lysis" or "do not essentially mediate lysis" means that an antibody construct of the present invention does not induce or mediate lysis of more than 30%, preferably not more than 20%, more preferably not more than 10%, particularly preferably not more than 9%, 8%, 7%, 6% or 5% of CD70 negative cells, whereby lysis of a CD70 positive cell line (see above) is set to be 100%. This usually applies for concentrations of the antibody construct of up to 500 nM. The skilled person knows how to measure cell lysis without further ado. Moreover, the present specification teaches specific instructions how to measure cell lysis.

The difference in cytotoxic activity between the monomeric and the dimeric isoform of individual CD70×CD3 bispecific antibody constructs is referred to as "potency gap". This potency gap can e.g. be calculated as ratio between EC50 values of the molecule's monomeric and dimeric form, see Example 15. Potency gaps of the CD70×CD3 bispecific antibody constructs of the present invention are preferably ≤5, more preferably ≤4, even more preferably ≤3, even more preferably ≤2 or ≤1.5, and most preferably ≤1.

The first and/or the second (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and/or second binding domain, in addition to binding to human CD70 and human CD3, respectively, will also bind to CD70/CD3 of primates including (but not limited to) new world primates (such as Callithrix jacchus, Saguinus Oedipus or Saimiri sciureus), old world primates (such as baboons and macaques), gibbons, orangutans, and non-human homininae. It is envisaged that the first binding domain of the antibody construct of the invention which binds to human CD70 on the surface of a target cell also binds at least to macaque CD70, and/or the second binding domain which binds to human CD3 on the surface of a T cell also binds at least to macaque CD3. A preferred macaque is *Macaca fascicularis*. *Macaca mulatta* (Rhesus) is also envisaged.

A preferred bispecific antibody construct of the invention comprises a first binding domain which binds to human CD70 on the surface of a target cell and a second binding domain which binds to human CD3 on the surface of a T cell and at least macaque CD3.

In one aspect of the invention, the first binding domain binds to human CD70 and further binds to macaque CD70, such as CD70 of *Macaca fascicularis*, and more preferably, to macaque CD70 ECD. A preferred *Macaca fascicularis* CD70 is depicted in SEQ ID NO: 755. A preferred macaque CD70 ECD is depicted in SEQ ID NO: 756. The affinity of the first binding domain for macaque CD70 is preferably ≤50 or ≤40 nM, more preferably ≤30 nM or ≤20 nM or ≤15 nM, more preferably ≤10 nM or ≤5 nM, even more preferably ≤2 nM or ≤1 nM, even more preferably ≤0.5 nM or ≤0.2 nM, and most preferably ≤0.1 nM.

Preferably the affinity gap of the antibody constructs according to the invention for binding macaque CD70 versus human CD70 [ma CD70:hu CD70] (as determined e.g. by BiaCore™ surface plasmon resonance or by Scatchard analysis) is between 0.1 and 10, more preferably between 0.2 and 5 or between 0.2 and 2, even more preferably between 0.3 and 4, even more preferably between 0.5 and 3 or between 0.5 and 2.5, and most preferably between 0.5 and 2 or between 0.6 and 2. See Examples 3 and 4.

In one embodiment of the antibody construct of the invention, the second binding domain binds to human CD3 epsilon and to Callithrix jacchus, Saguinus Oedipus or Saimiri sciureus CD3 epsilon. Preferably, the second binding domain binds to an extracellular epitope of these CD3 epsilon chains. It is also envisaged that the second binding domain binds to an extracellular epitope of the human and the *Macaca* CD3 epsilon chain. The most preferred epitope of CD3 epsilon is comprised within amino acid residues 1-27 of the human CD3 epsilon extracellular domain. Even more specifically, the epitope comprises at least the amino acid sequence Gln-Asp-Gly-Asn-Glu (SEQ ID NO: 1883). Callithrix jacchus and Saguinus oedipus are both new world primate belonging to the family of Callitrichidae, while Saimiri sciureus is a new world primate belonging to the family of Cebidae.

It is particularly preferred for the antibody construct of the present invention that the second binding domain which binds to human CD3 on the surface of a T cell comprises a VL region comprising CDR-L1, CDR-L2 and CDR-L3 selected from:

(a) CDR-L1 as depicted in SEQ ID NO: 27 of WO 2008/119567, CDR-L2 as depicted in SEQ ID NO: 28 of WO 2008/119567 and CDR-L3 as depicted in SEQ ID NO: 29 of WO 2008/119567;

(b) CDR-L1 as depicted in SEQ ID NO: 117 of WO 2008/119567, CDR-L2 as depicted in SEQ ID NO: 118 of WO 2008/119567 and CDR-L3 as depicted in SEQ ID NO: 119 of WO 2008/119567; and (c) CDR-L1 as depicted in SEQ ID NO: 153 of WO 2008/119567, CDR-L2 as depicted in SEQ ID NO: 154 of WO 2008/119567 and CDR-L3 as depicted in SEQ ID NO: 155 of WO 2008/119567.

In an alternatively preferred embodiment of the antibody construct of the present invention, the second binding domain which binds to human CD3 on the surface of a T cell comprises a VH region comprising CDR-H 1, CDR-H2 and CDR-H3 selected from:

(a) CDR-H1 as depicted in SEQ ID NO: 12 of WO 2008/119567, CDR-H2 as depicted in SEQ ID NO: 13 of WO 2008/119567 and CDR-H3 as depicted in SEQ ID NO: 14 of WO 2008/119567;

(b) CDR-H1 as depicted in SEQ ID NO: 30 of WO 2008/119567, CDR-H2 as depicted in SEQ ID NO: 31 of WO 2008/119567 and CDR-H3 as depicted in SEQ ID NO: 32 of WO 2008/119567;

(c) CDR-H1 as depicted in SEQ ID NO: 48 of WO 2008/119567, CDR-H2 as depicted in SEQ ID NO: 49 of WO 2008/119567 and CDR-H3 as depicted in SEQ ID NO: 50 of WO 2008/119567;

(d) CDR-H1 as depicted in SEQ ID NO: 66 of WO 2008/119567, CDR-H2 as depicted in SEQ ID NO: 67 of WO 2008/119567 and CDR-H3 as depicted in SEQ ID NO: 68 of WO 2008/119567;

(e) CDR-H1 as depicted in SEQ ID NO: 84 of WO 2008/119567, CDR-H2 as depicted in SEQ ID NO: 85 of WO 2008/119567 and CDR-H3 as depicted in SEQ ID NO: 86 of WO 2008/119567;

(f) CDR-H1 as depicted in SEQ ID NO: 102 of WO 2008/119567, CDR-H2 as depicted in SEQ ID NO: 103 of WO 2008/119567 and CDR-H3 as depicted in SEQ ID NO: 104 of WO 2008/119567;

(g) CDR-H1 as depicted in SEQ ID NO: 120 of WO 2008/119567, CDR-H2 as depicted in SEQ ID NO: 121 of WO 2008/119567 and CDR-H3 as depicted in SEQ ID NO: 122 of WO 2008/119567;

(h) CDR-H1 as depicted in SEQ ID NO: 138 of WO 2008/119567, CDR-H2 as depicted in SEQ ID NO: 139 of WO 2008/119567 and CDR-H3 as depicted in SEQ ID NO: 140 of WO 2008/119567;

(i) CDR-H1 as depicted in SEQ ID NO: 156 of WO 2008/119567, CDR-H2 as depicted in SEQ ID NO: 157 of WO 2008/119567 and CDR-H3 as depicted in SEQ ID NO: 158 of WO 2008/119567; and (j) CDR-H1 as depicted in SEQ ID NO: 174 of WO 2008/119567, CDR-H2 as depicted in SEQ ID NO: 175 of WO 2008/119567 and CDR-H3 as depicted in SEQ ID NO: 176 of WO 2008/119567.

It is further preferred for the antibody construct of the present invention that the second binding domain which binds to human CD3 on the surface of a T cell comprises a VL region selected from the group consisting of a VL region as depicted in SEQ ID NO: 35, 39, 125, 129, 161 or 165 of WO 2008/119567.

It is alternatively preferred that the second binding domain which binds to human CD3 on the surface of a T cell comprises a VH region selected from the group consisting of a VH region as depicted in SEQ ID NO: 15, 19, 33, 37, 51, 55, 69, 73, 87, 91, 105, 109, 123, 127, 141, 145, 159, 163, 177 or 181 of WO 2008/119567.

More preferably, the antibody construct of the present invention is characterized by the second binding domain which binds to human CD3 on the surface of a T cell comprising a VL region and a VH region selected from the group consisting of:

(a) a VL region as depicted in SEQ ID NO: 17 or 21 of WO 2008/119567 and a VH region as depicted in SEQ ID NO: 15 or 19 of WO 2008/119567;

(b) a VL region as depicted in SEQ ID NO: 35 or 39 of WO 2008/119567 and a VH region as depicted in SEQ ID NO: 33 or 37 of WO 2008/119567;

(c) a VL region as depicted in SEQ ID NO: 53 or 57 of WO 2008/119567 and a VH region as depicted in SEQ ID NO: 51 or 55 of WO 2008/119567;

(d) a VL region as depicted in SEQ ID NO: 71 or 75 of WO 2008/119567 and a VH region as depicted in SEQ ID NO: 69 or 73 of WO 2008/119567;

(e) a VL region as depicted in SEQ ID NO: 89 or 93 of WO 2008/119567 and a VH region as depicted in SEQ ID NO: 87 or 91 of WO 2008/119567;

(f) a VL region as depicted in SEQ ID NO: 107 or 111 of WO 2008/119567 and a VH region as depicted in SEQ ID NO: 105 or 109 of WO 2008/119567;

(g) a VL region as depicted in SEQ ID NO: 125 or 129 of WO 2008/119567 and a VH region as depicted in SEQ ID NO: 123 or 127 of WO 2008/119567;

(h) a VL region as depicted in SEQ ID NO: 143 or 147 of WO 2008/119567 and a VH region as depicted in SEQ ID NO: 141 or 145 of WO 2008/119567;

(i) a VL region as depicted in SEQ ID NO: 161 or 165 of WO 2008/119567 and a VH region as depicted in SEQ ID NO: 159 or 163 of WO 2008/119567; and (j) a VL region as depicted in SEQ ID NO: 179 or 183 of WO 2008/119567 and a VH region as depicted in SEQ ID NO: 177 or 181 of WO 2008/119567.

According to a preferred embodiment of the antibody construct of the present invention, the binding domains and in particular the second binding domain (which binds to human CD3 on the surface of a T cell) have the following format: The pairs of VH regions and VL regions are in the format of a single chain antibody (scFv). The VH and VL regions are arranged in the order VH-VL or VL-VH. It is preferred that the VH-region is positioned N-terminally of a linker sequence, and the VL-region is positioned C-terminally of the linker sequence.

A preferred embodiment of the above described antibody construct of the present invention is characterized by the second binding domain which binds to human CD3 on the surface of a T cell comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567.

Hence, in one embodiment, the antibody construct of the invention comprises a polypeptide selected from the group consisting of those depicted in SEQ ID NO: 10, SEQ ID NO: 20, SEQ ID NO: 30, SEQ ID NO: 40, SEQ ID NO: 50, SEQ ID NO: 60, SEQ ID NO: 70, SEQ ID NO: 80, SEQ ID NO: 90, SEQ ID NO: 100, SEQ ID NO: 110, SEQ ID NO: 120, SEQ ID NO: 130, SEQ ID NO: 140, SEQ ID NO: 150, SEQ ID NO: 160, SEQ ID NO: 170, SEQ ID NO: 180, SEQ ID NO: 190, SEQ ID NO: 200, SEQ ID NO: 210, SEQ ID NO: 220, SEQ ID NO: 230, SEQ ID NO: 240, SEQ ID NO: 250, SEQ ID NO: 260, SEQ ID NO: 270, SEQ ID NO: 280, SEQ ID NO: 290, SEQ ID NO: 300, SEQ ID NO: 310, SEQ ID NO: 320, SEQ ID NO: 330, SEQ ID NO: 340, SEQ ID NO: 350, SEQ ID NO: 360, SEQ ID NO: 370, SEQ ID NO: 380, SEQ ID NO: 390, SEQ ID NO: 400, SEQ ID NO: 410, SEQ ID NO: 420, SEQ ID NO: 430, SEQ ID NO: 440, SEQ ID NO: 450, SEQ ID NO: 460, SEQ ID NO: 470, SEQ ID NO: 480, SEQ ID NO: 490, SEQ ID NO: 500, SEQ ID NO: 510, SEQ ID NO: 520, SEQ ID NO: 530, SEQ ID NO: 540, SEQ ID NO: 550, SEQ ID NO: 560, SEQ ID NO: 570, SEQ ID NO: 580, SEQ ID NO: 590, SEQ ID NO: 600, SEQ ID NO: 610, SEQ ID NO: 620, SEQ ID NO: 630, SEQ ID NO: 640, SEQ ID NO: 650, SEQ ID NO: 660, SEQ ID NO: 670, SEQ ID NO: 680, SEQ ID NO: 690, SEQ ID NO: 700, SEQ ID NO: 710, SEQ ID NO: 720, SEQ ID NO: 730, SEQ ID NO: 740, SEQ ID NO: 923, SEQ ID NO: 927, SEQ ID NO: 931, SEQ ID NO: 935, SEQ ID NO: 939, SEQ ID NO: 943, SEQ ID NO: 947, SEQ ID NO: 951, SEQ ID NO: 955, SEQ ID NO: 959, SEQ ID NO: 963, SEQ ID NO: 967, SEQ ID NO: 971, SEQ ID NO: 975, SEQ ID NO: 979, SEQ ID NO: 983, SEQ ID NO: 987, SEQ ID NO: 991, SEQ ID NO: 995, SEQ ID NO: 999, SEQ ID NO: 1003, SEQ ID NO: 1007, SEQ ID NO: 1011, SEQ ID NO: 1015, SEQ ID NO: 1019, SEQ ID NO: 1023, SEQ ID NO: 1027, SEQ ID NO: 1031, SEQ ID NO: 1035, SEQ ID NO: 1039, SEQ ID NO: 1043, SEQ ID NO: 1053, SEQ ID NO: 1057, SEQ ID NO: 1067, SEQ ID NO: 1071, SEQ ID NO: 1081, SEQ ID NO: 1085, SEQ ID NO: 1095, SEQ ID NO: 1099, SEQ ID NO: 1109, SEQ ID NO: 1113, SEQ ID NO: 1123, SEQ ID NO: 1127, SEQ ID NO: 1137, SEQ ID NO: 1141, SEQ ID NO: 1151, SEQ ID NO: 1155, SEQ ID NO: 1165, SEQ ID NO: 1169, SEQ ID NO: 1179, SEQ ID NO: 1183, SEQ ID NO: 1193, SEQ ID NO: 1197, SEQ ID NO: 1207, SEQ ID NO: 1211, SEQ ID NO: 1221, SEQ ID NO: 1225, SEQ ID NO: 1235, SEQ ID NO: 1239, SEQ ID NO: 1249, SEQ ID NO: 1253, SEQ ID NO: 1263, SEQ ID NO: 1267, SEQ ID NO: 1277, SEQ ID NO: 1281, SEQ ID NO: 1291, SEQ ID NO: 1295, SEQ ID NO: 1305, SEQ ID NO: 1309, SEQ ID NO: 1319, SEQ ID NO: 1323, SEQ ID NO: 1333, SEQ ID NO: 1337, SEQ ID NO: 1347, SEQ ID NO: 1351, SEQ ID NO: 1361, SEQ ID NO: 1365, SEQ ID NO: 1375, SEQ ID NO: 1379, SEQ ID NO: 1389, SEQ ID NO: 1393, SEQ ID NO: 1403, SEQ ID NO: 1407, SEQ ID NO: 1417, SEQ ID NO: 1421, SEQ ID NO: 1431, SEQ ID NO: 1435, SEQ ID NO: 1445, SEQ ID NO: 1449, SEQ ID NO: 1459, SEQ ID NO: 1463, SEQ ID NO: 1473, SEQ ID NO: 1477, SEQ ID NO: 1487, SEQ ID NO: 1491, SEQ ID NO: 1501, SEQ ID NO: 1505, SEQ ID NO: 1515, SEQ ID NO: 1519, SEQ ID NO: 1529, SEQ ID NO: 1533, SEQ ID NO: 1543, SEQ ID NO: 1547, SEQ ID NO: 1557, SEQ ID NO: 1561, SEQ ID NO: 1571, and SEQ ID NO: 1575.

Preferred is when the antibody construct of the invention comprises a polypeptide selected from the group consisting of those depicted in SEQ ID NO: 1053, SEQ ID NO: 1095, SEQ ID NO: 1151, SEQ ID NO: 1179, SEQ ID NO: 1193, SEQ ID NO: 1221, SEQ ID NO: 1235, SEQ ID NO: 1249, SEQ ID NO: 1263, SEQ ID NO: 1277, SEQ ID NO: 1347, SEQ ID NO: 1361, SEQ ID NO: 1375, SEQ ID NO: 1431, and SEQ ID NO: 1445.

Amino acid sequence modifications of the antibody constructs described herein are also contemplated. For example, it may be desirable to improve the binding affinity and/or other biological properties of the antibody construct. Amino acid sequence variants of the antibody constructs are prepared by introducing appropriate nucleotide changes into the antibody constructs nucleic acid, or by peptide synthesis. All of the below described amino acid sequence modifications should result in an antibody construct which still retains the desired biological activity (binding to CD70 and to CD3) of the unmodified parental molecule.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

Amino acid modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites.

For example, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs. Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. An insertional variant of the antibody construct of the invention includes the fusion to the N-terminus or to the C-terminus of the antibody construct of an enzyme or the fusion to a polypeptide which increases the serum half-life of the antibody construct.

The sites of greatest interest for substitutional mutagenesis include the CDRs of the heavy and/or light chain, in particular the hypervariable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions are then refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done using assays of antigen binding activities, such as CD70 or CD3 binding.

Generally, if amino acids are substituted in one or more or all of the CDRs of the heavy and/or light chain, it is preferred that the then-obtained "substituted" sequence is at least 60% or 65%, more preferably 70% or 75%, even more preferably 80% or 85%, and particularly preferably 90% or 95% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 3, below) is envisaged as long as the antibody construct retains its capability to bind to CD70 via the first binding domain and to CD3 or CD3 epsilon via the second binding domain and/or its CDRs have an identity to the then substituted sequence (at least 60% or 65%, more preferably 70% or 75%, even more preferably 80% or 85%, and particularly preferably 90% or 95% identical to the "original" CDR sequence).

Conservative substitutions are shown in Table 3 under the heading of "preferred substitutions". If such substitutions result in a change in biological activity, then more substantial changes, denominated "exemplary substitutions" in Table 3, or as further described below in reference to amino acid classes, may be introduced and the products screened for a desired characteristic.

TABLE 3

Amino acid substitutions

| Original | Exemplary Substitutions | Preferred Substitutions |
|---|---|---|
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | asp |
| Gly (G) | Ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | Ala | ala |
| Ser (S) | Thr | thr |
| Thr (T) | Ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gin, his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

For amino acid sequences, sequence identity and/or similarity is determined by using standard techniques known in the art, including, but not limited to, the local sequence identity algorithm of Smith and Waterman, 1981, Adv. Appl. Math. 2:482, the sequence identity alignment algorithm of Needleman and Wunsch, 1970, J. Mol. Biol. 48:443, the search for similarity method of Pearson and Lipman, 1988, Proc. Nat. Acad. Sci. U.S.A. 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, Nucl. Acid Res. 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, J. Mol. Evol. 35:351-360; the method is similar to that described by Higgins and Sharp, 1989, CABIOS 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, J. Mol. Biol. 215:403-410; Altschul et al., 1997, Nucleic Acids Res. 25:3389-3402; and Karin et al., 1993, Proc. Natl. Acad. Sci. U.S.A. 90:5873-5787. A particularly useful BLAST program is the WU-BLAST-2 program which was obtained from Altschul et al., 1996, Methods in Enzymology 266: 460-480. WU-BLAST-2 uses several search parameters, most of which are set to the default values. The adjustable parameters are set with the following values: overlap span=1, overlap fraction=0.125, word threshold (T)=||. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, Nucl. Acids Res. 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs are at least 60% to the sequences depicted herein, and more typically with preferably increasing homologies or identities of at least 65% or 70%, more preferably at least 75% or 80%, even more preferably at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antibody construct. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs and the nucleotide sequences depicted herein are at least 60%, and more typically with preferably increasing homologies or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Thus, a "variant CDR" is one with the specified homology, similarity, or identity to the parent CDR of the invention, and shares biological function, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR.

In one embodiment, the percentage of identity to human germline of the antibody constructs according to the invention is ≥70% or ≥75%, more preferably ≥80% or ≥85%, even more preferably ≥90%, and most preferably ≥91%, ≥92%, ≥93%, ≥94%, ≥95% or even ≥96%, ≥97% or ≥98%. See Example 7. Identity to human antibody germline gene products is thought to be an important feature to reduce the risk of therapeutic proteins to elicit an immune response against the drug in the patient during treatment. Hwang & Foote ("Immunogenicity of engineered antibodies"; Methods 36 (2005) 3-10) demonstrate that the reduction of non-human portions of drug antibody constructs leads to a decrease of risk to induce anti-drug antibodies in the patients during treatment. By comparing an exhaustive number of clinically evaluated antibody drugs and the respective immunogenicity data, the trend is shown that humanization of the V-regions of antibodies makes the protein less immunogenic (average 5.1% of patients) than antibodies carrying unaltered non-human V regions (average 23.59% of patients). A higher degree of identity to human sequences is hence desirable for V-region based protein therapeutics in the form of antibody constructs. For this purpose of determining the germline identity, the V-regions of VL can be aligned with the amino acid sequences of human germline V segments and J segments (http://vbase.mrc-cpe.cam.ac.uk/) using Vector NTI software and the amino acid sequence calculated by dividing the identical amino acid residues by the total number of amino acid residues of the VL in percent. The same can be done for the VH segments (http://vbase.mrc-cpe.cam.ac.uk/) with the exception that the VH CDR3 may be excluded due to its high diversity and a lack of existing human germline VH CDR3 alignment partners. Recombinant techniques can then be used to increase sequence identity to human antibody germline genes.

In a further embodiment, the bispecific antibody constructs of the present invention exhibit high monomer yields under standard research scale conditions, e.g., in a standard two-step purification process. Preferably the monomer yield of the antibody constructs according to the invention is ≥0.25 mg/L supernatant, more preferably ≥0.5 mg/L, even more preferably ≥1 mg/L, and most preferably ≥2.5 mg/L supernatant.

Likewise, the yield of the dimeric antibody construct isoforms and hence the monomer percentage (i.e., monomer: (monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≥80%, more preferably ≥85%, even more preferably ≥90%, and most preferably ≥95%.

In one embodiment, the antibody constructs have a preferred plasma stability (ratio of EC50 with plasma to EC50 w/o plasma) of ≤8 or ≤7 or ≤6, more preferably ≤5 or ≤4, more preferably ≤3.5 or ≤3, even more preferably ≤2.5 or ≤2, and most preferably ≤1.5 or ≤1. The plasma stability of an antibody construct can be tested by incubation of the construct in human plasma at 37° C. for 24 hours followed by EC50 determination in a 51-chromium release cytotoxicity assay. The effector cells in the cytotoxicity assay can be stimulated enriched human CD8 positive T cells. Target cells can e.g. be CHO cells transfected with human CD70. The effector to target cell (E:T) ratio can be chosen as 10:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of EC50 (after plasma incubation) to EC50 (control). See Example 11.

It is furthermore preferred that the monomer to dimer conversion of antibody constructs of the invention is low. The conversion can be measured under different conditions and analyzed by high performance size exclusion chromatography. See Example 9. For example, incubation of the monomeric isoforms of the antibody constructs can be carried out for 7 days at 37° C. and concentrations of e.g. 100 μg/ml or 250 μg/ml in an incubator. Under these conditions, it is preferred that the antibody constructs of the invention show a dimer percentage that is ≤5%, more preferably ≤4%, even more preferably ≤3%, even more preferably ≤2.5%, even more preferably ≤2%, even more preferably ≤1.5%, and most preferably ≤1%, ≤0.6%, or ≤0.5%, ≤0.3% or even 0%.

It is also preferred that the bispecific antibody constructs of the present invention present with very low dimer conversion after a number of freeze/thaw cycles. For example, the antibody construct monomer is adjusted to a concentration of 250 μg/ml e.g. in generic formulation buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are ≤5%, more preferably ≤4%, even more preferably ≤3%, even more preferably ≤2.5%, even more preferably ≤2%, even more preferably ≤1.5%, and most preferably ≤1% or even ≤0.5% or 0%, for example after three freeze/thaw cycles.

The bispecific antibody constructs of the present invention preferably show a favorable thermostability with aggregation temperatures ≥45° C. or ≥50° C., more preferably ≥52° C. or ≥54° C., even more preferably ≥56° C. or ≥57° C., and most preferably ≥58° C. or ≥59° C. or ≥60° C. The thermostability parameter can be determined in terms of antibody aggregation temperature as follows: Antibody solution at a concentration 250 μg/ml is transferred into a single use cuvette and placed in a Dynamic Light Scattering (DLS) device. The sample is heated from 40° C. to 70° C. at a heating rate of 0.5° C./min with constant acquisition of the measured radius. Increase of radius indicating melting of the protein and aggregation is used to calculate the aggregation temperature of the antibody. See Example 10.

Alternatively, temperature melting curves can be determined by Differential Scanning Calorimetry (DSC) to determine intrinsic biophysical protein stabilities of the antibody constructs. These experiments are performed using a MicroCal LLC (Northampton, MA, U.S.A) VP-DSC device. The energy uptake of a sample containing an antibody construct is recorded from 20° C. to 90° C. compared to a sample containing only the formulation buffer. The antibody constructs are adjusted to a final concentration of 250 μg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

It is furthermore envisaged that the CD70×CD3 bispecific antibody constructs of the invention do not cross-react with (i.e., do not essentially bind to) the human CD70 paralogue CD40L. Furthermore, it is envisaged that the CD70×CD3 bispecific antibody constructs of the invention do not cross-react with (i.e., do not essentially bind to) the macaque/cyno CD70 paralogue CD40L. See Example 6.

It is furthermore envisaged that the binding of the first binding domain of the antibody constructs of the invention to human CD70 is reduced by the presence of soluble CD27 by s 25%, preferably ≤20%, more preferably ≤15%, more preferably ≤10%, even more preferably s 5%, and most preferably ≤2%. It is envisaged that the concentration of CD27 in this context is physiological, e.g., between about 100 and about 500 μg/ml, or even higher, e.g., up to 1 μg/ml. For details of the assay see Example 16.

The CD70×CD3 bispecific antibody constructs of the invention are also envisaged to have a turbidity (as measured by OD340 after concentration of purified monomeric antibody construct to 2.5 mg/ml and over night incubation) of ≤0.2, preferably of ≤0.15, more preferably of ≤0.12, even more preferably of ≤0.1, and most preferably of ≤0.08 or ≤0.05. See Example 12.

The CD70×CD3 bispecific antibody constructs of the invention are also envisaged to not be internalized or to not undergo significant internalization by the target cell. Changes in the potency of the CD70×CD3 bispecific antibody construct as a function of preincubation of the construct on the target cells in the absence of T cells can be measured. If the antibody construct is internalized, it should undergo lysosomal degradation. The effective concentration should decrease with time, and thus the apparent potency should decrease as well. The effect is observed with other targets, for which this is a known phenomenon.

The rate of internalization can be assayed e.g. as follows: T cells are counted and diluted to a concentration of $1\times10^5$/ml in assay media. CD70 positive (e.g. natural expresser) cells are counted and plated at 2500 cells per well (cpw). The antibody construct is diluted serially 1:2, at a starting concentration of 100 nM. The antibody construct is added to the culture assay plates to allow for 0 hours, 1 hour or 2 hours of incubation prior to addition of the T cells. Then the T cells are plated at 25000 cpw, and the assay is incubated for 48 hours at 37° C. Target cell survival is analyzed e.g. with the Steady-Glo® system (25 μl/well). Preferably, the internalization rate is ≤20% after a 2 hour (pre-)incubation of the antibody construct with the target cell, more preferably ≤15%, even more preferably ≤10%, and most preferably ≤5%.

In a further embodiment the antibody construct according to the invention is stable at acidic pH. The more tolerant the antibody construct behaves at unphysiologic pH such as pH 5.5 (a pH which is required to run e.g. a cation exchange chromatography), the higher is the recovery of the antibody construct eluted from an ion exchange column relative to the total amount of loaded protein. Recovery of the antibody construct from an ion (e.g., cation) exchange column at pH 5.5 is preferably ≥50%, more preferably ≥60% or ≥65%, even more preferably ≥70% or ≥72% or ≥74% or ≥76% or ≥78%, even more preferably ≥80%, even more preferably ≥90%, even more preferably ≥95%, and most preferably ≥99%. See Example 13.

It is furthermore envisaged that the bispecific antibody constructs of the present invention exhibit therapeutic efficacy or anti-tumor activity. This can e.g. be assessed in a study as disclosed in the following example of an advanced stage human tumor xenograft model:

On day 1 of the study, $5\times10^6$ cells of a human CD70 positive cancer cell line are subcutaneously injected in the right dorsal flank of female NOD/SCID mice. When the mean tumor volume reaches about 100 $mm^3$, in vitro expanded human CD3 positive T cells are transplanted into the mice by injection of about $2\times10^7$ cells into the peritoneal cavity of the animals. Mice of vehicle control group 1 do not receive effector cells and are used as an untransplanted control for comparison with vehicle control group 2 (receiving effector cells) to monitor the impact of T cells alone on tumor growth. The antibody treatment starts when the mean tumor volume reaches about 200 mm3. The mean tumor size of each treatment group on the day of treatment start should not be statistically different from any other group (analysis of variance). Mice are treated with 0.5 mg/kg/day of a CD70×CD3 bispecific antibody construct by intravenous bolus injection for about 15 to 20 days. Tumors are measured by caliper during the study and progress evaluated by intergroup comparison of tumor volumes (TV). The tumor growth inhibition T/C [%] is determined by calculating TV as T/C %=100×(median TV of analyzed group)/(median TV of control group 2).

The skilled person knows how to modify or adapt certain parameters of this study, such as the number of injected tumor cells, the site of injection, the number of transplanted human T cells, the amount of bispecific antibody constructs to be administered, and the timelines, while still arriving at a meaningful and reproducible result. Preferably, the tumor growth inhibition T/C [%] is ≤70 or ≤60, more preferably ≤50 or ≤40, even more preferably ≤30 or ≤20 and most preferably ≤10 or ≤5 or even ≤2.5.

The invention further provides a polynucleotide/nucleic acid molecule encoding an antibody construct of the invention.

A polynucleotide is a biopolymer composed of 13 or more nucleotide monomers covalently bonded in a chain. DNA (such as cDNA) and RNA (such as mRNA) are examples of polynucleotides with distinct biological function. Nucleotides are organic molecules that serve as the monomers or subunits of nucleic acid molecules like DNA or RNA. The nucleic acid molecule or polynucleotide can be double stranded and single stranded, linear and circular. It is preferably comprised in a vector which is preferably comprised in a host cell. Said host cell is, e.g. after transformation or transfection with the vector or the polynucleotide of the invention, capable of expressing the antibody construct. For that purpose the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code. While the genetic code determines the protein sequence for a given coding region, other genomic regions can influence when and where these proteins are produced.

Furthermore, the invention provides a vector comprising a polynucleotide/nucleic acid molecule of the invention.

A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using calcium phosphate, by electroporation, by cell squeezing or by mixing a cationic lipid with the material to produce liposomes, which fuse with the cell membrane and deposit their cargo inside.

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be effected by artificial means. For transformation to happen, cells or bacteria must be in a state of competence, which might occur as a time-limited response to environmental conditions such as starvation and cell density.

Moreover, the invention provides a host cell transformed or transfected with the polynucleotide/nucleic acid molecule or with the vector of the invention.

As used herein, the terms "host cell" or "recipient cell" are intended to include any individual cell or cell culture that can be or has/have been recipients of vectors, exogenous nucleic acid molecules, and polynucleotides encoding the antibody construct of the present invention; and/or recipients of the antibody construct itself. The introduction of the respective material into the cell is carried out by way of transformation, transfection and the like. The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include but are not limited to bacteria, yeast cells, fungi cells, plant cells, and animal cells such as insect cells and mammalian cells, e.g., murine, rat, macaque or human.

The antibody construct of the invention can be produced in bacteria. After expression, the antibody construct of the invention is isolated from the *E. coli* cell paste in a soluble fraction and can be purified through, e.g., affinity chromatography and/or size exclusion. Final purification can be carried out similar to the process for purifying antibody expressed e.g., in CHO cells.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as *K. lactis, K. fragilis* (ATCC 12424), *K. bulgaricus* (ATCC 16045), K. wickeramii (ATCC 24178), *K. waltii* (ATCC 56500), *K. drosophilarum* (ATCC 36906), *K. thermotolerans*, and *K. marxianus; yarrowia* (EP 402 226); *Pichia pastoris* (EP 183 070); *Candida; Trichoderma* reesia (EP 244 234); *Neurospora crassa; Schwanniomyces* such as *Schwanniomyces occidentalis*; and filamentous fungi such as *Neurospora, Penicillium, Tolypocladium*, and *Aspergillus* hosts such as *A. nidulans* and *A. niger.*

Suitable host cells for the expression of glycosylated antibody construct of the invention are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, *petunia*, tomato, *Arabidopsis* and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2,1413 8065); mouse mammary tumor (MMT 060562, ATCC CCL5 1); TRI cells (Mather et al., Annals N. Y Acad. Sci. (1982) 383: 44-68); MRC 5 cells; FS4 cells; and a human hepatoma line (Hep G2).

In a further embodiment the invention provides a process for the production of an antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. The term "expression" includes any step involved in the production of an antibody construct of the invention including, but not limited to, transcription, post-transcriptional modification, translation, post-translational modification, and secretion.

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, ethanol precipitation, Reverse Phase HPLC, chromatography on silica, chromatography on heparin SEPHAROSE™, chromatography on an anion or cation exchange resin (such as a polyaspartic acid column), chromato-focusing, SDS-PAGE, and ammonium sulfate precipitation are also available depending on the antibody to be recovered. Where the antibody construct of the invention comprises a CH3 domain, the Bakerbond ABX resin (J.T. Baker, Phillipsburg, NJ) is useful for purification.

Affinity chromatography is a preferred purification technique. The matrix to which the affinity ligand is attached is most often agarose, but other matrices are available. Mechanically stable matrices such as controlled pore glass or poly (styrenedivinyl) benzene allow for faster flow rates and shorter processing times than can be achieved with agarose.

Moreover, the invention provides a pharmaceutical composition comprising an antibody construct of the invention or an antibody construct produced according to the process of the invention.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions.

The inventive compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods.

Certain embodiments provide pharmaceutical compositions comprising the antibody construct of the invention and further one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

In certain embodiments, the pharmaceutical composition may contain formulation materials for the purpose of modifying, maintaining or preserving, e.g., the pH, osmolarity, viscosity, clarity, color, isotonicity, odor, sterility, stability, rate of dissolution or release, adsorption or penetration of the composition (see, REMINGTON'S PHARMACEUTICAL SCIENCES, 18" Edition, (A. R. Genrmo, ed.), 1990, Mack Publishing Company). In such embodiments, suitable formulation materials may include, but are not limited to:

- amino acids such as glycine, alanine, glutamine, asparagine, threonine, proline, 2-phenylalanine, including charged amino acids, preferably lysine, lysine acetate, arginine, glutamate and/or histidine
- antimicrobials such as antibacterial and antifungal agents
- antioxidants such as ascorbic acid, methionine, sodium sulfite or sodium hydrogen-sulfite;
- buffers, buffer systems and buffering agents which are used to maintain the composition at physiological pH or at a slightly lower pH, typically within a pH range of from about 5 to about 8 or 9; examples of buffers are borate, bicarbonate, Tris-HCl, citrates, phosphates or other organic acids, succinate, phosphate, histidine and acetate; for example Tris buffer of about pH 7.0-8.5, or acetate buffer of about pH 4.0-5.5;
- non-aqueous solvents such as propylene glycol, polyethylene glycol, vegetable oils such as olive oil, and injectable organic esters such as ethyl oleate;
- aqueous carriers including water, alcoholic/aqueous solutions, emulsions or suspensions, including saline and buffered media;
- biodegradable polymers such as polyesters;
- bulking agents such as mannitol or glycine;
- chelating agents such as ethylenediamine tetraacetic acid (EDTA);
- isotonic and absorption delaying agents;
- complexing agents such as caffeine, polyvinylpyrrolidone, beta-cyclodextrin or hydroxypropyl-beta-cyclodextrin)
- fillers;
- monosaccharides; disaccharides; and other carbohydrates (such as glucose, mannose or dextrins); carbohydrates may be non-reducing sugars, preferably trehalose, sucrose, octasulfate, sorbitol or xylitol;
- (low molecular weight) proteins, polypeptides or proteinaceous carriers such as human or bovine serum albumin, gelatin or immunoglobulins, preferably of human origin;
- coloring and flavouring agents;
- sulfur containing reducing agents, such as glutathione, thioctic acid, sodium thioglycolate, thioglycerol, [alpha]-monothioglycerol, and sodium thio sulfate
- diluting agents;
- emulsifying agents;
- hydrophilic polymers such as polyvinylpyrrolidone)
- salt-forming counter-ions such as sodium;
- preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide);
- metal complexes such as Zn-protein complexes;
- solvents and co-solvents (such as glycerin, propylene glycol or polyethylene glycol);
- sugars and sugar alcohols, such as trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols;
- suspending agents;
- surfactants or wetting agents such as pluronics, PEG, sorbitan esters, polysorbates such as polysorbate 20, polysorbate, triton, tromethamine, lecithin, cholesterol, tyloxapal; surfactants may be detergents, preferably with a molecular weight of >1.2 KD and/or a polyether, preferably with a molecular weight of >3 KD; non-limiting examples for preferred detergents are TWEEN® 20, TWEEN® 40, TWEEN® 60, TWEEN® 80 and TWEEN® 85 (Sigma-Aldrich): non-limiting examples for preferred polyethers are PEG 3000, PEG 3350, PEG 4000 and PEG 5000;

stability enhancing agents such as sucrose or sorbitol;

tonicity enhancing agents such as alkali metal halides, preferably sodium or potassium chloride, mannitol sorbitol;

parenteral delivery vehicles including sodium chloride solution, Ringer's dextrose, dextrose and sodium chloride, lactated Ringer's, or fixed oils;

intravenous delivery vehicles including fluid and nutrient replenishers, electrolyte replenishers (such as those based on Ringer's dextrose).

It is evident to those skilled in the art that the different constituents of the pharmaceutical composition (e.g., those listed above) can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

It is envisaged that the composition of the invention might comprise, in addition to the polypeptide of the invention defined herein, further biologically active agents, depending on the intended use of the composition. Such agents might be drugs acting on the gastrointestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In certain embodiments, the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the antibody construct of the invention may be formulated as a lyophilizate using appropriate excipients such as sucrose.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained- or controlled-delivery/release formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

The antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Another aspect of the invention includes self-buffering antibody construct of the invention formulations, which can be used as pharmaceutical compositions, as described in international patent application WO 06138181A2 (PCT/

US2006/022599). A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution" in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions", Pharm Biotechnol. 13: 159-75 (2002), see particularly the parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic". Destabilizing solutes are referred to as "chaotropic". Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations. Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard. Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. Ca+2 ions (up to 100 mM) can increase the stability of human deoxyribonuclease. Mg+2, Mn+2, and Zn+2, however, can destabilize rhDNase. Similarly, Ca+2 and Sr+2 can stabilize Factor VIII, it can be destabilized by Mg+2, Mn+2 and Zn+2, Cu+2 and Fe+2, and its aggregation can be increased by Al+3 ions.

Embodiments of the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody construct are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody construct of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g.

metabolism, excretion, etc. By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma. "Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific antibody constructs exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

One embodiment provides the antibody construct of the invention or the antibody construct produced according to the process of the invention for use in the prevention, treatment or amelioration of a tumor or cancer disease or of a metastatic cancer disease. It is envisaged that this tumor or cancer or metastatic cancer is CD70 expressing.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having a tumor or cancer or a metastatic cancer as specified herein below, by the administration of an antibody construct according to the invention to a subject in need thereof. Such an improvement may also be seen as a slowing or stopping of the progression of the tumor or cancer or metastatic cancer of the patient. The term "prevention" as used herein means the avoidance of the occurrence or re-occurrence of a patient having a tumor or cancer or a metastatic cancer as specified herein below, by the administration of an antibody construct according to the invention to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question.

A "neoplasm" is an abnormal growth of tissue, usually but not always forming a mass. When also forming a mass, it is commonly referred to as a "tumor". Neoplasms or tumors or can be benign, potentially malignant (pre-cancerous), or malignant. Malignant neoplasms are commonly called cancer. They usually invade and destroy the surrounding tissue and may form metastases, i.e., they spread to other parts, tissues or organs of the body. Hence, the term "metastatic cancer" encompasses metastases to other tissues or organs than the one of the original tumor. Lymphomas and leukemias are lymphoid neoplasms. For the purposes of the present invention, they are also encompassed by the terms "tumor" or "cancer".

In a preferred embodiment of the invention, the tumor or cancer disease is selected from the group consisting of renal, lung, pancreatic, ovarian, breast, colon, head and neck, stomach, rectal, thymic, and brain tumor or cancer, leukemia, lymphoma, melanoma, Kaposi's Sarcoma, embryonal carcinoma, and a metastatic cancer disease derived from any of the foregoing.

More specifically, the tumor or cancer disease can be selected from the group consisting of renal cell carcinoma (RCC), clear cell RCC (ccRCC), papillary RCC, chromophobe RCC, sarcomatoid RCC, non-small cell lung cancer (NSCLC), lung squamous carcinoma, pancreatic adenocarcinoma such as pancreatic ductal adenocarcinoma, non-small cell lung cancer (NSCLC), lung squamous carcinoma, laryngeal carcinoma, pharyngeal carcinoma, nasopharyngeal carcinoma, undifferentiated carcinoma of the rhinopharynx, lymphoepithelioma, glioblastoma, glioma, meningioma, acute lymphocytic leukemia (ALL), chronic lymphocytic leukemia (CLL), T-cell leukemia, adult T-cell leukemia, B-cell lineage cancer, B-cell lymphoma, diffuse large B cell lymphoma (DLBCL), non-Hodgkin's lymphoma (NHL), Burkitt's lymphoma, anaplastic large-cell lymphomas (ALCL), multiple myeloma, cutaneous T-cell lymphomas, nodular small cleaved-cell lymphomas, lymphocytic lymphomas, peripheral T-cell lymphomas, Lennert's lymphomas, immunoblastic lymphoma, T-cell lymphoma, entroblastic/centrocytic (cb/cc) follicular lymphoma, angioimmunoblastic lymphadenopathy (AILD)-like T cell lymphoma, HIV associated body cavity based lymphoma, Castleman's disease, or Waldenstrom's macroglobulinemia. The metastatic cancer disease can be derived from any of the foregoing.

The invention also provides a method for the treatment or amelioration of tumor or cancer disease or a metastatic cancer disease, comprising the step of administering to a subject in need thereof the antibody construct of the invention or the antibody construct produced according to the process of the invention. It is envisaged that this tumor or cancer or metastatic cancer is CD70 expressing.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to

- topical routes (such as epicutaneous, inhalational, nasal, ophthalmic, auricular/aural, vaginal, mucosal);
- enteral routes (such as oral, gastrointestinal, sublingual, sublabial, buccal, rectal); and
- parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 pg/kg to up to about 30 mg/kg or more, depending on the factors mentioned above. In specific embodiments, the dosage may range from 1.0 pg/kg up to about 20 mg/kg, optionally from 10 μg/kg up to about 10 mg/kg or from 100 μg/kg up to about 5 mg/kg.

A therapeutic effective amount of an antibody construct of the invention preferably results in a decrease in severity of disease symptoms, an increase in frequency or duration of disease symptom-free periods or a prevention of impairment or disability due to the disease affliction. For treating CD70-expressing tumors, a therapeutically effective amount of the antibody construct of the invention, e.g. an anti-CD70/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy in human tumors.

The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct of the invention as defined herein or separately before or after administration of said antibody construct in timely defined intervals and doses.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

In a further embodiment, the invention provides a kit comprising an antibody construct of the invention, an antibody construct produced according to the process of the invention, a polynucleotide/nucleic acid molecule of the invention, a vector of the invention, and/or a host cell of the invention.

In the context of the present invention, the term "kit" means two or more components—one of which corresponding to the antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

THE FIGURES SHOW

FIG. 1: Expression control of the constructs used for epitope mapping on CHO cells, using an anti-V5 antibody. See Example 1.

Figure 2:
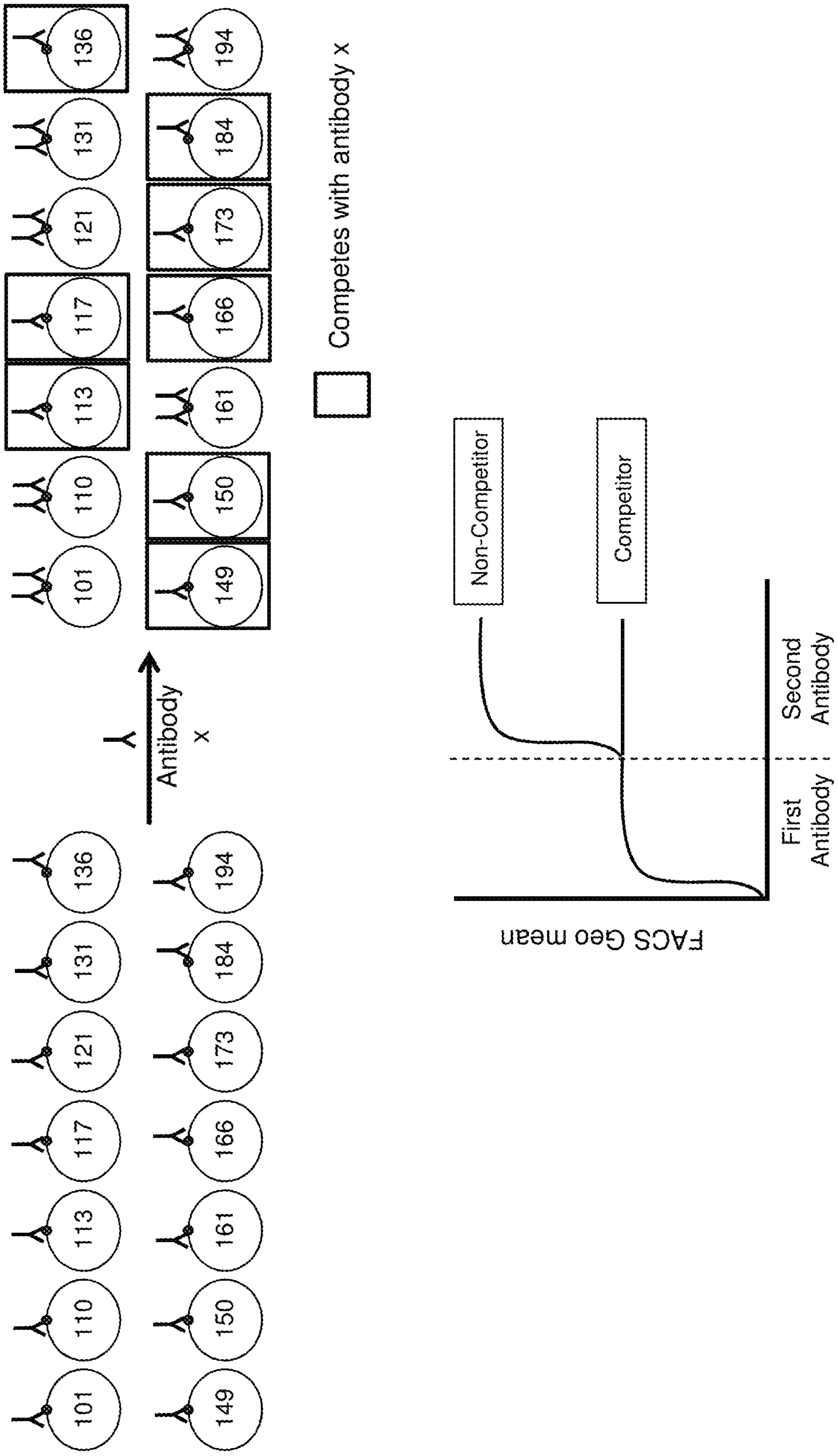

FIG. 2: Schematic representation of a multiplex epitope binning or competition assay and FACS read-out. 14 beads are pre-coated, each with a different antibody. The second antibody "X" is added, and additional binding is determined. If no additional binding can be determined, the antibodies compete for binding with one another.

Figure 3:
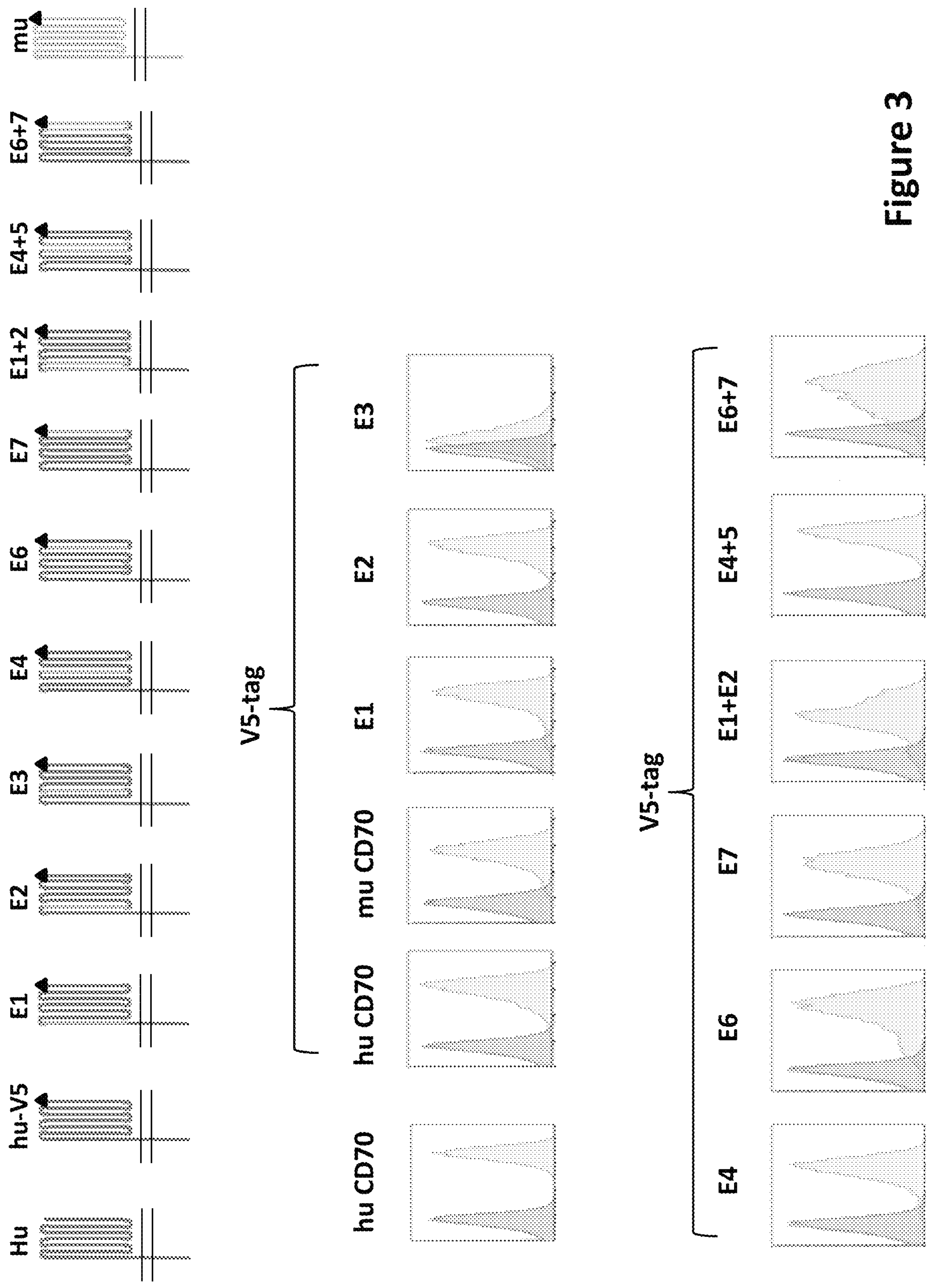

FIG. 3: Experimental set-up of the epitope mapping analysis, see Example 2. A V5 tag was fused via a glycine/serine linker to the C-terminus of the chimeric molecules, as indicated.

Figure 4A:
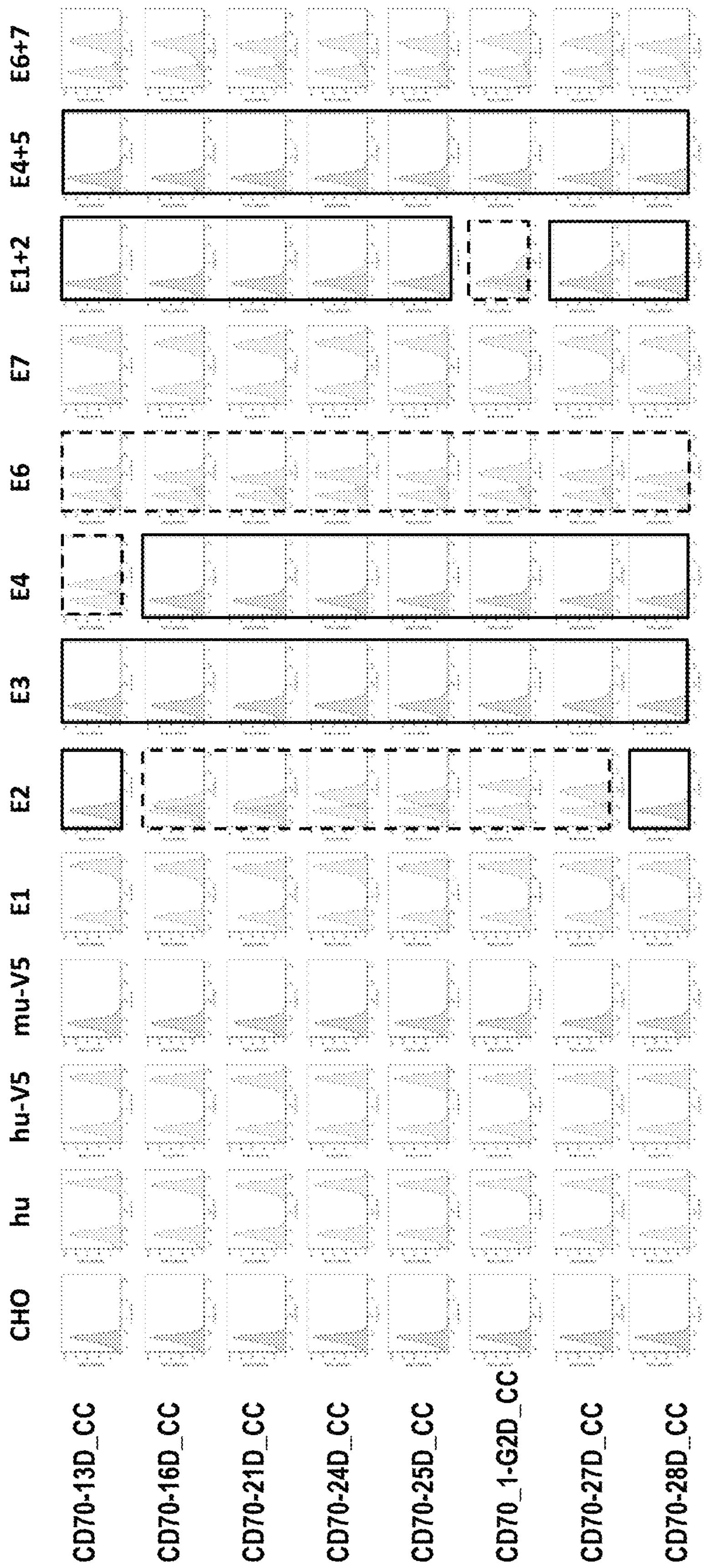
Figure 4B:
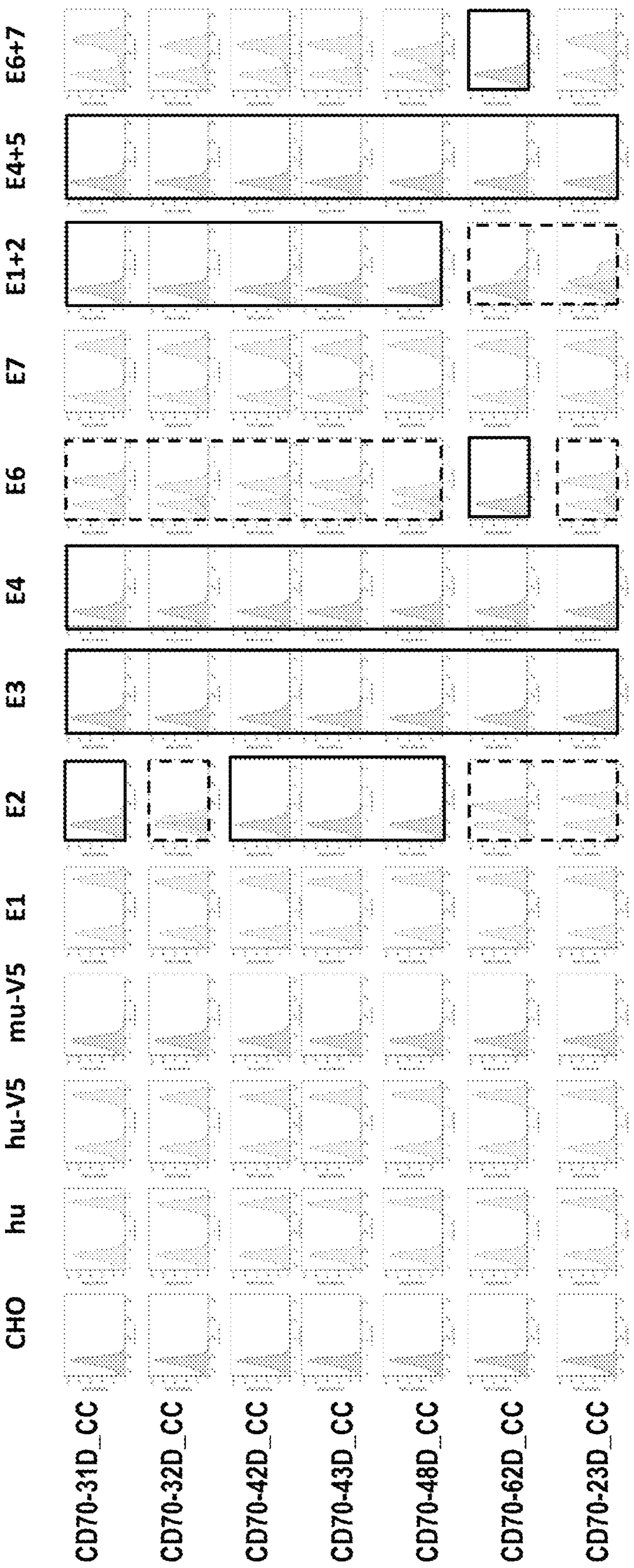

FIGS. 4A and 4B: Epitope mapping result of several exemplary CD70×CD3 bispecific binders in an scFc format, carried out as described in Example 2. Although not specifically indicated in FIGS. 4A and 4B, all constructs were CD70×CD3 (I2C) bispecific and in scFc format. The x-axis depicts Comp. PE-A (PE=phycoerythrin; A=signal area), and the y-axis depicts counts (events) normalized to mode.

Figure 5A:
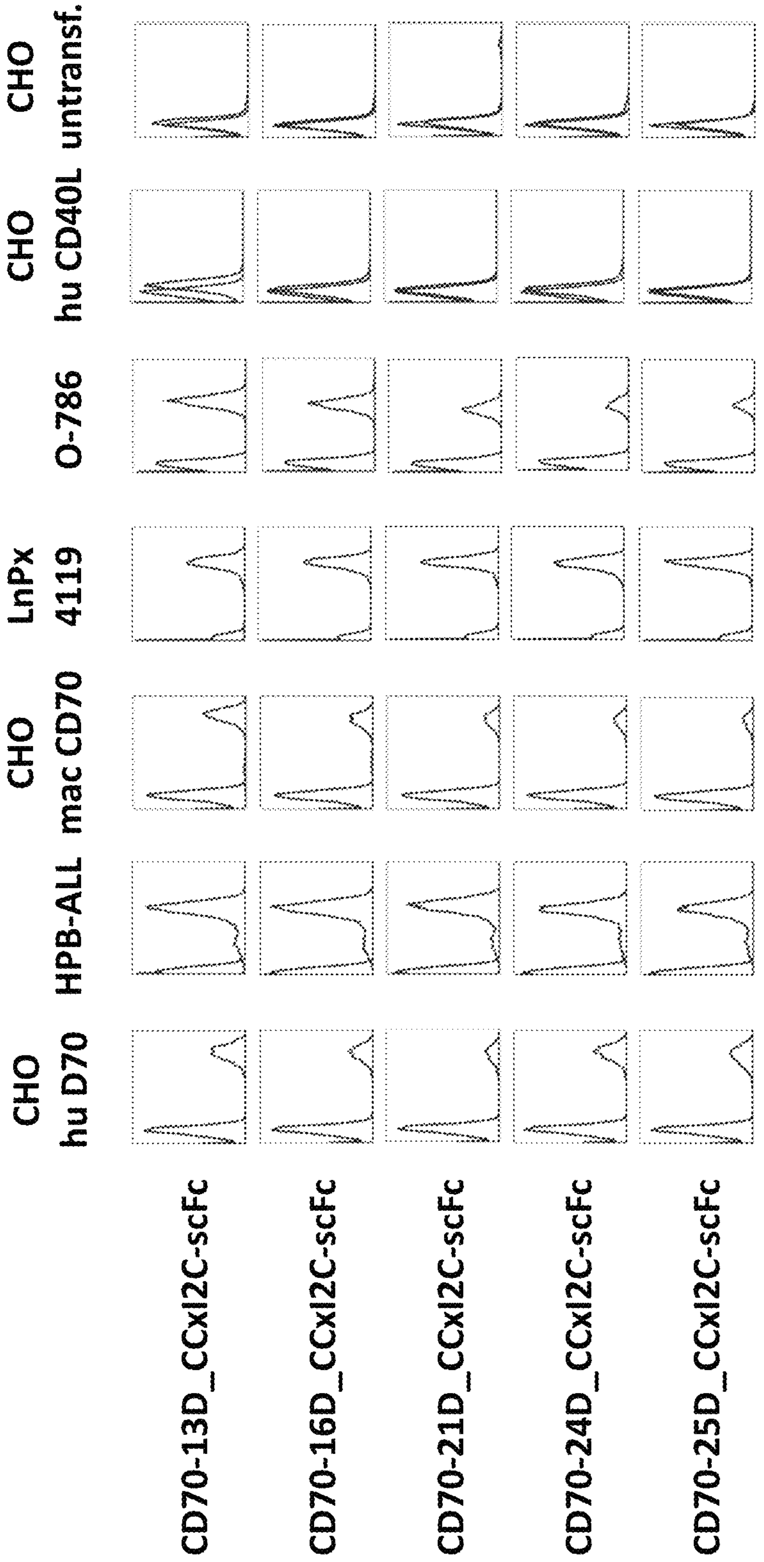
Figure 5B:
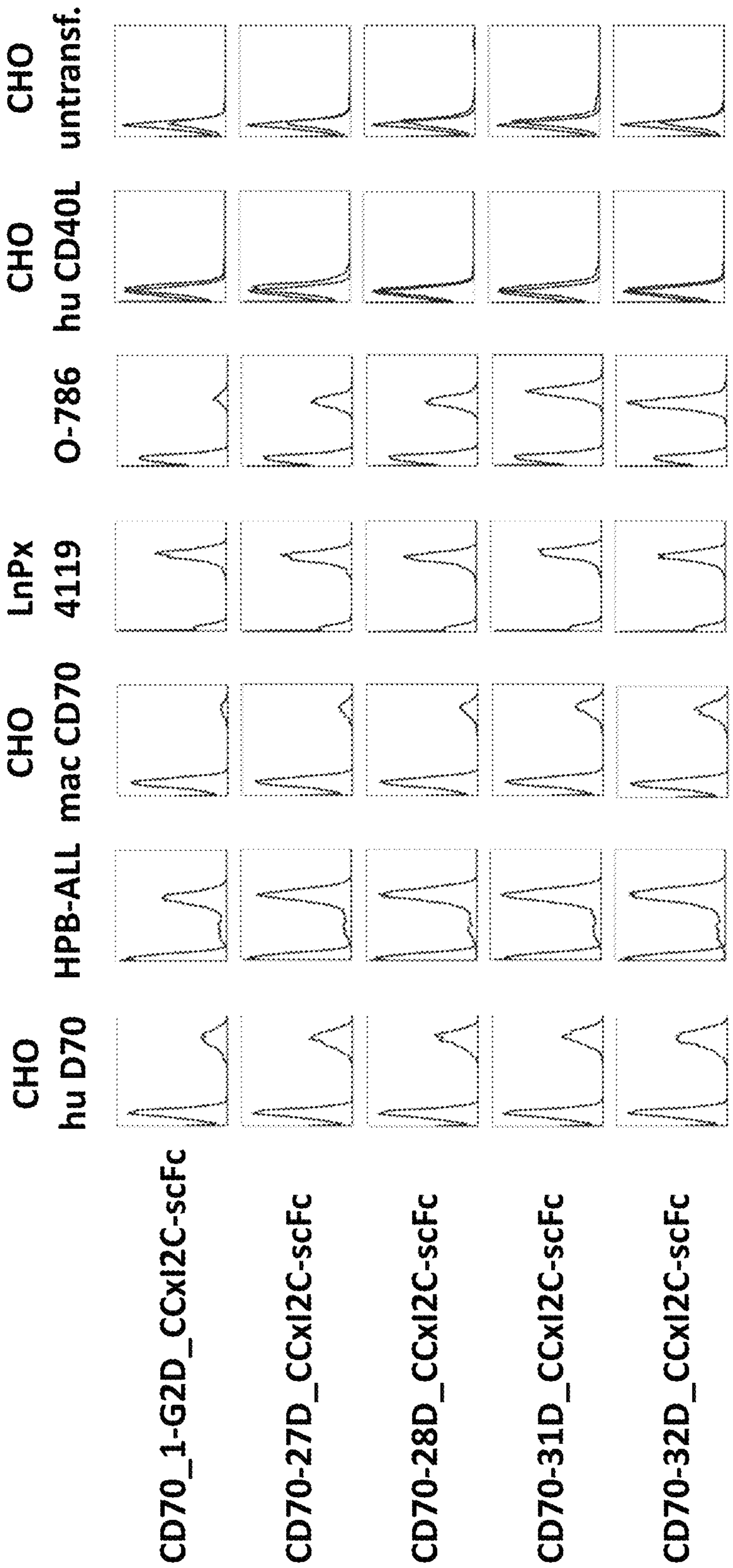
Figure 5C:
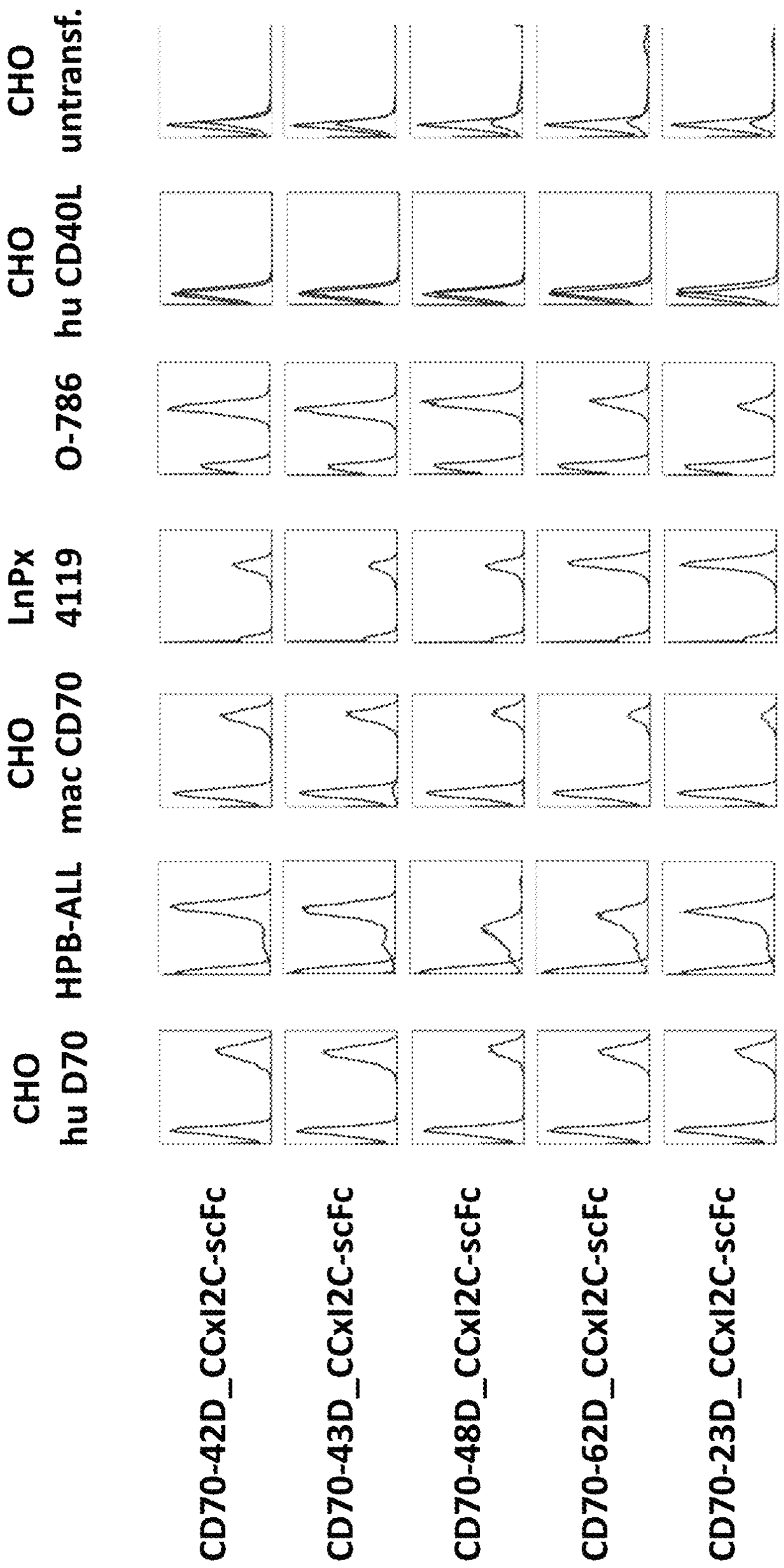

FIGS. 5A-5C: Bispecific binding, interspecies cross-reactivity and absence of binding to human CD70 paralogue CD40L, shown for a representative number of antibody constructs in an scFc format, as analyzed in Examples 5 and 6. The x-axis depicts Comp. PE-A (PE=phycoerythrin; A=signal area), and the y-axis depicts counts (events).

Figure 6:
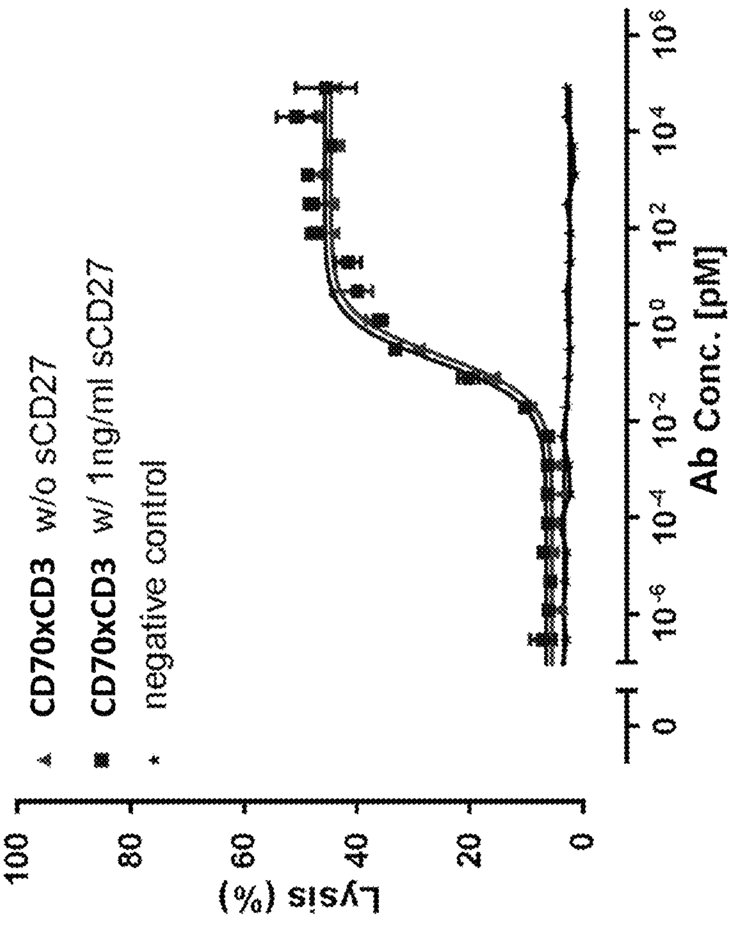

FIG. 6: Cytotoxic activity of CD70-21D_CC×I2C-scFc as analyzed in a FACS-based cytotoxicity assay using CHO cells transfected with human CD70 as target cells, and unstimulated human PBMC as effector cells. The assay was carried out as described in Example 8.5. In a parallel approach, soluble CD27 was added in a concentration of 1 ng/ml. The presence of the soluble form of CD27 did not impair the cytotoxic activity of the tested antibody construct.

EXAMPLES

The following examples illustrate the invention. These examples should not be construed as to limit the scope of this invention. The present invention is limited only by the claims.

Example 1

Generation of CHO Cells Expressing Wild Type and Truncated CD70

The extracellular domain of the CD70 antigen can be subdivided into different sub-domains or regions E1 to E7 that are defined, for the purposes of Examples 1 and 2, by the following amino acid positions:

| | | |
|---|---|---|
| E1 | aa 43-62 | SEQ ID NO: 743 |
| E2 | aa 63-84 | SEQ ID NO: 744 |
| E3 | aa 85-109 | SEQ ID NO: 745 |
| E4 | aa 110-134 | SEQ ID NO: 746 |
| E5 | aa 135-151 | SEQ ID NO: 747 |
| E6 | aa 152-175 | SEQ ID NO: 748 |
| E7 | aa 176-193 | SEQ ID NO: 749 |
| E1 + 2 | aa 43-84 | SEQ ID NO: 750 |
| E3 + 4 | aa 85-134 | SEQ ID NO: 751 |
| E4 + 5 | aa 110-151 | SEQ ID NO: 752 |
| E5 + 6 | aa 135-175 | SEQ ID NO: 753 |
| E6 + 7 | aa 152-193 | SEQ ID NO: 754 |

For the construction of the human/mouse chimeric CD70 molecules used for epitope mapping (Example 2), the sequences of the respective seven human regions as well as the five combinations of two neighboring human regions (see above) were replaced with the corresponding regions from murine CD70. Furthermore, a V5 tag (GKPIPNPLLGLDST) was fused via a "GGGGS" linker to the C-terminus of the chimeric molecules. The final chimeric molecule sequences are depicted in SEQ ID NOs: 759-768. In addition, full length human CD70 (SEQ ID NO: 741) and full-length mouse CD70 (SEQ ID NO: 757) were constructed, both having a V5 tag (GKPIPNPLLGLDST) fused via a "GGGGS" linker to their C-terminus.

For the generation of CHO dhfr− cells expressing the above constructs, the respective coding sequences were cloned into a plasmid designated pEF-DHFR (pEF-DHFR is described in Raum et al. Cancer Immunol Immunother 50 (2001) 141-150). CHO cells transfected with human CD70, but without the V5 tag, were also generated. All cloning procedures were carried out according to standard protocols (Sambrook, Molecular Cloning; A Laboratory Manual, 3rd edition, Cold Spring Harbour Laboratory Press, Cold Spring Harbour, New York (2001)). For each construct, a corresponding plasmid was transfected into DHFR deficient CHO cells for eukaryotic expression, as described by Kaufman R. J. (1990) Methods Enzymol. 185, 537-566.

The expression of the constructs on the CHO cells was verified using a monoclonal mouse IgG2a anti-v5 tag antibody (1 µg/ml; AbD Serotec, #MCA 1360). Bound monoclonal antibody was detected with an anti-mouse IgG Fc-gamma-PE. As negative control, cells were incubated with isotype control antibody instead of the first antibody. The samples were measured by flow cytometry. CHO transfectants did not express E5 alone or E5+6. See FIG. 1.

Example 2

Epitope Mapping of Anti-CD70 Antibody Constructs

The CHO cells generated as described in Example 1 were stained with crude, undiluted periplasmic extract containing individual anti-CD70 scFv molecules. Bound scFv were detected with mouse monoclonal anti-FLAG M2 antibody (1 µg/ml; Sigma F1804) followed by an anti-mouse IgG Fc-gamma-PE (1:100; Jackson Immunoresearch #115-116-071). All antibodies were diluted in PBS/1.5% FCS. As negative control, cells were incubated with PBS/2% FCS instead of the periplasmic extract. The samples were measured by flow cytometry. While all tested anti-CD70 scFv molecules were able to bind to human CD70 w/o the V5 tag (strong FACS signal), none of them was able to bind to murine CD70 (no FACS signal).

The binders were classified into different groups (I, II, III, IIIv, V, VI, VII and VIII), depending on the chimeric CD70 molecule for which a loss of binding was observed. The loss of binding is in most of the cases complete, but can in some cases also be partial. A merely partial loss of binding was observed in particular for the region denominated E6 (see Groups II, IIIv, VI and VIII), but in some cases also for other regions. For some binders tested, the results obtained with the combination of two neighboring regions (E1+2, E3+4, E4+5, E6+7) were not always explicit. Therefore, the classification into the different groups was mainly driven by the results obtained with those chimeric molecules having only one region replaced with the murine counterpart region. Results are shown in Table 4.

TABLE 4

Several regions of the extracellular CD70 domain (E2, E3, E4, E6 and combinations thereof) were identified as comprising an epitope recognized by the respectivea nti-CD70 binding molecules, as detected by a complete or partial loss of the FACS signal.

| Group* | Loss of signal in these chimeric molecules: | CD70 binder specific for region: | Denomination of binder: CD70-x* |
|---|---|---|---|
| i | E2, E3, E4, E6<br>E1 + 2, E3 + 4, E4 + 5, E6 + 7 | E2/E3/E4/E6 | X = 4, 7, 9, 13, 35, 44, 45, 47, 48, 49, 50, 52, 57, 61, 62, 65, 67, 68, 73 |
| ii | E2, E3, E4, (E6 partial)<br>E1 + 2, E3 + 4, E4 + 5 | E2/E3/E4/(E6) | x = 2, 8, 14, 15, 16, 17, 18, 20, 26, 28, 29, 30, 31, 32, 33, 34, 36, 37, 38, 40, 41, 42, 43, 46, 53, 58, 59, 63, 66, 74 |
| III | E2, E3, E6<br>E1 + 2, E6 + 7 | E2/E3/E6 | x = 1, 11 |
| IIIv | E2, E3, (E6 partial) | E2/E3/(E6) | x =3 |
| V | E3, E4, E6<br>E3 + 4, E4 + 5, E6 + 7 | E3/E4/E6 | x = 12 |
| VI | E3, E4, (E6 partial)<br>E3 + 4, E4 + 5 | E3/E4/(E6) | x = 19, 21, 22, 23, 24, 25, 27, 39, 51, 54, 64, 69 |

TABLE 4-continued

Several regions of the extracellular CD70 domain (E2, E3, E4, E6 and combinations thereof) were identified as comprising an epitope recognized by the respectivea nti-CD70 binding molecules, as detected by a complete or partial loss of the FACS signal.

| Group* | Loss of signal in these chimeric molecules: | CD70 binder specific for region: | Denomination of binder: CD70-x* |
|---|---|---|---|
| VII | huCD70-V5 and all chimeric constructs | V5 tag inhibits binding | x = 55, 56, 60, 70, 71, 72 |
| VIII | E3, (E6 partial) | E3/(E6) | x = 5, 6, 10 |

*The denomination of the groups and of the binders is also used in the sequence listing.

None of the anti-CD70 scFv molecules showed a loss of binding for the "E1" or for the "E7" chimeric molecule. Hence, the first binding domain of the antibody constructs of the invention seems to not bind to an epitope comprised within the region denominated E1, and it seems to not bind to an epitope comprised within the region denominated E7. In Group VII, it appears that the presence of the V5 tag in the chimeric molecules interferes with the binding of the anti-CD70 scFv molecules. Therefore, the epitope could not be determined. It can be speculated that this group of anti-CD70 scFv molecules binds to an epitope comprised within the region denominated E7, as this region is neighboring to the V5 tag.

FIG. 3 shows the experimental set-up, and FIGS. 4A and 4B show the epitope mapping result of several exemplary bispecific binders in an scFc format.

Example 3

BiaCore™- and Octet Based Determination of Antibody Affinity to Human and Cynomolgus CD70 and CD3

BiaCore™ surface plasmon resonance analysis experiments were performed using recombinant human/cyno CD70-ECD fusion proteins with albumin to determine target binding of the antibody constructs of the invention.

In detail, CM5 Sensor Chips (GE Healthcare) were immobilized with approximately 600-800 RU of the respective recombinant antigen using acetate buffer pH 4.5 according to the manufacturer's manual. The CD70×CD3 bispecific antibody construct samples were loaded in a dilution series of the following concentrations: 50 nM, 25 nM, 12.5 nM, 6.25 nM and 3.13 nM diluted in HBS-EP running buffer (GE Healthcare). Flow rate was 30 µl/min for 3 min, then HBS-EP running buffer was applied for 8 min to 20 min again at a flow rate of 30 µl/ml. Regeneration of the chip was performed using 10 mM glycine 10 mM NaCl pH 1.5 solution. Data sets were analyzed using BiaEval Software. In general two independent experiments were performed.

Furthermore, Octet analysis experiments were performed using recombinant human/cyno CD70-NHS-PEG Biotin to determine target binding of the antibody constructs of the invention. In detail, Streptavidin-Tips were immobilized with approximately 0.1-0.2 nm of the respective recombinant antigen according to the manufacturer's manual. The CD70×CD3 bispecific antibody construct samples were prepared in a dilution series of the following concentrations: 300 nM, 150 nm, 75 nM, 37.5 nM, 18.8 nM, an 9.4 nM diluted in HBS-EP running buffer (GE Healthcare). For every dilution, one Streptavidin-Tip was immobilized with the antigen. The association was measured in a black 96 well MTP, Flow rate was 1000 rpm for 8 min association. For dissociation the tips were incubated in HBS-EP running buffer for 15 min to 30 min again at a flow rate of 1000 rpm. Data sets were analyzed using ForteBio Data Analysis Software. In general two independent experiments were performed.

The analyzed CD70×CD3 bispecific antibody constructs in an scFc format showed very high affinities to human CD70 in the 1-digit nanomolar range (except for one construct in the very low 2-digit nanomolar range), as determined by Octet analysis. Binding to macaque CD70 was balanced, also showing affinities in the 1-digit nanomolar range. The affinity values as well as the calculated affinity gap are shown in Table 5.

TABLE 5

Affinities of CD70xCD3 (I2C) bispecific antibody constructs to human and macaque CD70 as determined by Octet analysis, as well as the calculated interspecies affinity gaps. All constructs were measured in two independent experiments each using a dilution series, except for those marked with an (*) which were measured in one experiment only.

| CD70xCD3 bispecific antibody construct | Octet based affinity hu CD70 [nM] | Octet based affinity mac CD70 [nM] | Affinity gap KD mac/ KD hu |
|---|---|---|---|
| CD70-13D_CCxI2C-scFc | 5.84 ± 1.07 | 5.41 ± 2.33 | 0.93 |
| CD70-16D_CCxI2C-scFc | 2.80 ± 1.30 | 0.60* | 0.21 |
| CD70-21D_CCxI2C-scFc | 0.81 ± 0.42 | 0.34* | 0.42 |
| CD70-24D_CCxI2C-scFc | 12.75 ± 0.35 | 8.75 ± 4.74 | 0.69 |
| CD70-25D_CCxI2C-scFc | 1.51 ± 0.43 | 1.57 ± 0.82 | 1.04 |
| CD70_1-G2D_CCxI2C-scFc | 2.35 ± 0.42 | 1.44 ± 0.32 | 0.61 |
| CD70-27D_CCxI2C-scFc | 5.84 ± 1.18 | 5.31 ± 0.22 | 0.91 |
| CD70-28D_CCxI2C-scFc | 5.50 ± 0.59 | 7.87 ± 0.78 | 1.43 |
| CD70-31D_CCxI2C-scFc | 5.44 ± 2.52 | 7.45 ± 1.03 | 1.37 |
| CD70-32D_CCxI2C-scFc | 4.07 ± 0.28 | 4.96 ± 0.57 | 1.22 |
| CD70-42D_CCxI2C-scFc | 2.56 ± 0.13 | 4.46 ± 0.35 | 1.74 |
| CD70-43D_CCxI2C-scFc | 6.92 ± 1.27 | 5.82 ± 2.26 | 0.84 |
| CD70-48D_CCxI2C-scFc | 2.12 ± 0.02 | 3.38 ± 0.10 | 1.59 |
| CD70-62D_CCxI2C-scFc | 3.05 ± 0.04 | 3.35 ± 0.43 | 1.10 |
| CD70-23D_CCxI2C-scFc | 2.58 ± 0.23 | 2.57 ± 0.12 | 1.00 |

Furthermore, the binding of the bispecific antibody constructs to human CD3 and macaque CD3 as well as to human and cyno FcRn was confirmed in a BiaCore™ surface plasmon resonance assay and was shown to be strong and well balanced. The analyzed CD70×CD3 bispecific antibody constructs in an scFc format showed high affinities to human CD3 in the very low 2-digit or in the 1-digit nanomolar range. Binding to macaque CD3 was balanced, also showing affinities in similar ranges. The affinity values as well as the calculated affinity gap are shown in Table 6.

TABLE 6

Affinities of CD70xCD3 (I2C) bispecific antibody constructs to human and macaque CD3 as determined by BiaCore ™ surface plasmon resonance analysis, as well as the calculated interspecies affinity gaps.

| CD70xCD3 bispecific antibody construct | BiaCore ™ based affinity hu CD3 [nM] | BiaCore ™ based affinity cyno CD3 [nM] | Affinity gap KD mac/ KD hu |
|---|---|---|---|
| CD70-13D_CCxI2C-scFc | 13.35 ± 0.78 | 11.05 ± 0.64 | 0.83 |
| CD70-16D_CCxI2C-scFc | 14.05 ± 0.64 | 12.50 ± 1.84 | 0.89 |
| CD70-21D_CCxI2C-scFc | 12.60 ± 0.28 | 10.65 ± 0.35 | 0.85 |
| CD70-24D_CCxI2C-scFc | 13.15 ± 1.48 | 10.70 ± 1.41 | 0.81 |
| CD70-25D_CCxI2C-scFc | 12.75 ± 2.05 | 10.39 ± 2.14 | 0.81 |
| CD70_1-G2D_CCxI2C-scFc | 12.95 ± 0.35 | 10.75 ± 0.21 | 0.83 |
| CD70-27D_CCxI2C-scFc | 12.20 ± 2.26 | 10.05 ± 2.19 | 0.82 |
| CD70-28D_CCxI2C-scFc | 10.13 ± 1.66 | 8.56 ± 1.48 | 0.85 |
| CD70-31D_CCxI2C-scFc | 14.60 ± 1.13 | 12.22 ± 0.99 | 0.84 |
| CD70-32D_CCxI2C-scFc | 13.55 ± 1.91 | 11.40 ± 1.70 | 0.84 |
| CD70-42D_CCxI2C-scFc | 8.13 ± 0.21 | 7.96 ± 1.50 | 0.98 |
| CD70-43D_CCxI2C-scFc | 8.21 ± 0.76 | 6.81 ± 0.74 | 0.83 |
| CD70-48D_CCxI2C-scFc | 10.64 ± 1.22 | 9.09 ± 0.83 | 0.85 |
| CD70-62D_CCxI2C-scFc | 9.02 ± 1.20 | 7.67 ± 1.17 | 0.85 |
| CD70-23D_CCxI2C-scFc | 11.70 ± 1.13 | 9.65 ± 1.06 | 0.82 |

Example 4

Scatchard-Based Analysis of CD70×CD3 Bispecific Antibody Construct Affinity to Human and Macaque CD70 on Target Antigen Positive Cells and Determination of the Interspecies Affinity Gap The affinities of CD70×CD3 bispecific antibody constructs to CHO cells transfected with human or macaque CD70 were also determined by Scatchard analysis as the most reliable method for measuring potential affinity gaps between human and macaque CD70. For the Scatchard analysis, saturation binding experiments are performed using a monovalent detection system to precisely determine monovalent binding of the CD70×CD3 bispecific antibody constructs to the respective cell line.

$2\times10^4$ cells of the respective cell line (recombinantly human $CD70^-$expressing CHO cell line, recombinantly macaque CD70-expressing CHO cell line) were incubated each with 50 µl of a triplet dilution series (twelve dilutions at 1:2) of the respective CD70×CD3 bispecific antibody construct (until saturation is reached) starting at 10-20 nM followed by 16 h incubation at 4° C. under agitation and one residual washing step. Then, the cells were incubated for another hour with 30 µl of a CD3×ALEXA488 conjugate solution. After one washing step, the cells were resuspended in 150 µl FACS buffer containing 3.5% formaldehyde, incubated for further 15 min, centrifuged, resuspended in FACS buffer and analyzed using a FACS CantoII machine and FACS Diva software. Data were generated from two independent sets of experiments, each using triplicates. Respective Scatchard analysis was calculated to extrapolate maximal binding (Bmax). The concentrations of CD70×CD3 bispecific antibody constructs at half-maximal binding were determined reflecting the respective KDs. Values of triplicate measurements were plotted as hyperbolic curves and as S-shaped curves to demonstrate proper concentration ranges from minimal to optimal binding.

The results are shown in Table 7 for a representative number of antibody constructs in an scFc format. Cell based Scatchard analysis confirmed that the CD70×CD3 bispecific antibody constructs of the invention are in the low nanomolar range in affinity to human CD70 and to mac CD70 and present with a small and very favorable cyno/human interspecies affinity gap of around 1.

TABLE 7

Affinities (KD) of CD70xCD3 bispecific antibody constructs as determined in cell based Scatchard analysis with the calculated affinity gap KD macaque CD70/KD human CD70. Antibody constructs were measured in two independent experiments, each using triplicates.

| CD70xCD3 bispecific antibody construct | Cell based affinity hu CD70 [nM] | Cell based affinity mac CD70 [nM] | Affinity gap KD mac/ KD hu |
|---|---|---|---|
| CD70-13D_CCxI2C-scFc | 7.64 ± 1.20 | 7.22 ± 1.60 | 0.95 |
| CD70-16D_CCxI2C-scFc | 6.93 ± 1.61 | 7.71 ± 1.74 | 1.11 |
| CD70-21D_CCxI2C-scFc | 10.77 ± 0.98 | 11.63 ± 1.22 | 1.08 |
| CD70-24D_CCxI2C-scFc | 8.30 ± 2.75 | 11.76 ± 2.55 | 1.42 |
| CD70-25D_CCxI2C-scFc | 11.08 ± 4.74 | 12.57 ± 2.02 | 1.13 |
| CD70_1-G2D_CCxI2C-scFc | 10.56 ± 1.25 | 9.80 ± 0.73 | 0.93 |
| CD70-27D_CCxI2C-scFc | 9.19 ± 0.54 | 10.53 ± 0.98 | 1.15 |
| CD70-28D_CCxI2C-scFc | 8.04 ± 1.73 | 7.18 ± 0.45 | 0.89 |
| CD70-31D_CCxI2C-scFc | 9.40 ± 0.78 | 10.54 ± 1.51 | 1.12 |
| CD70-32D_CCxI2C-scFc | 9.26 ± 4.36 | 7.56 ± 0.78 | 0.82 |
| CD70-42D_CCxI2C-scFc | 9.08 ± 2.21 | 9.15 ± 0.16 | 1.01 |
| CD70-43D_CCxI2C-scFc | 8.73 ± 3.56 | 9.14 ± 5.73 | 1.05 |
| CD70-48D_CCxI2C-scFc | 6.64 ± 0.13 | 6.56 ± 0.50 | 0.99 |
| CD70-62D_CCxI2C-scFc | 4.02 ± 0.12 | 5.17 ± 1.61 | 1.29 |
| CD70-23D_CCxI2C-scFc | 4.72 ± 0.11 | 6.58 ± 0.85 | 1.39 |

Example 5

Bispecific Binding and Interspecies Cross-Reactivity

For confirmation of binding to human CD70 and CD3 and to cyno CD70 and CD3, bispecific antibody constructs of the invention were tested by flow cytometry using

- CHO cells transfected with human CD70 and with macaque CD70, respectively,
- the CD70 positive human ovarian carcinoma cell line OVCAR 8 (but other CD70 positive human cell lines such as the renal clear cell adenocarcinoma cell line O-786 are also conceivable)
- CD3-expressing human T cell leukemia cell line HPB-all (DSMZ, Braunschweig, ACC483), and
- the cynomolgus CD3-expressing T cell line LnPx 4119

For flow cytometry 200,000 cells of the respective cell lines were incubated for 60 min at 4° C. with 50 µl of purified bispecific antibody construct at a concentration of 5 µg/ml. The cells were washed twice in PBS/2% FCS and then incubated with an in-house mouse antibody (2 µg/ml) specific for the CD3 binding part of the bispecific antibody constructs for 30 min at 4° C. After washing, bound mouse antibodies were detected with a goat anti-mouse Fcγ-PE (1:100) for 30 min at 4° C. Samples were measured by flow cytometry. Non-transfected CHO cells were used as negative control.

The results are shown in FIG. 5A-5C for a representative number of antibody constructs in an scFc format. All tested CD70×CD3 constructs stained CHO cells transfected with human CD70 and with cyno CD70, and they also stained the CD70 positive renal clear cell adenocarcinoma cell line 0-786 (natural expresser). Human and cyno T cell lines expressing CD3 were also recognized by the bispecific antibody constructs. Moreover, there was no staining of the negative control cells (CHO cells transfected with human CD40L and non-transfected CHO cells).

Example 6

Confirmation of the Absence of Binding to Human Paralogues

Human CD70 paralogue CD40L was stably transfected into CHO cells. The sequence of the paralogue as used in the present example is identified in the sequence listing (SEQ ID NO: 769). Protein expression was confirmed in FACS analyses with specific antibodies. The flow cytometry assay was carried out as described in Example 5. The results are shown in FIGS. 5A-5C and also referred to in Example 5. The analysis confirmed that none of the CD70×CD3 bispecific antibody constructs of the invention cross-reacts with the human CD70 paralogue CD40L.

Example 7

Identity to Human Germline

In order to analyze the identity/similarity of the sequence of the antibody constructs to the human antibody germline genes, the CD70 binding domains of the invention were aligned as follows: Full VL including all CDRs was aligned; full VH including CDRs 1 and 2 but except CDR3 was aligned against human antibody germline genes (Vbase). More details can be found in the specification of this application. The results are shown in Table 8 below. All variants show high germline similarity.

TABLE 8

Percentage of identity of VH and VL to human germline

| CD70xCD3 bispecific antibody construct | % identity to human germline [VH] | % identity to human germline [VL] |
|---|---|---|
| CD70-13D_CCxI2C-scFc | 92.86 | 95.51 |
| CD70-16D CCxI2C-scFc | 93.88 | 97.75 |
| CD70-21D_CCxI2C-scFc | 92.86 | 96.63 |
| CD70-24D_CCxI2C-scFc | 94.90 | 98.88 |
| CD70-25D_CCxI2C-scFc | 93.88 | 97.75 |
| CD70_1-G2D_CCxI2C-scFc | 93.88 | 96.63 |
| CD70-27D_CCxI2C-scFc | 94.90 | 96.63 |
| CD70-28D_CCxI2C-scFc | 94.90 | 95.51 |
| CD70-31D_CCxI2C-scFc | 91.84 | 94.38 |
| CD70-32D_CCxI2C-scFc | 92.86 | 95.51 |
| CD70-42D_CCxI2C-scFc | 94.90 | 96.63 |
| CD70-43D_CCxI2C-scFc | 92.86 | 96.63 |
| CD70-48D_CCxI2C-scFc | 90.82 | 95.45 |
| CD70-62D_CCxI2C-scFc | 92.86 | 97.73 |

Example 8

Cytotoxic Activity

The potency of CD70×CD3 bispecific antibody constructs of the invention in redirecting effector T cells against CD70-expressing target cells was analyzed in five in vitro cytotoxicity assays:

- The potency of CD70×CD3 bispecific antibody constructs in redirecting stimulated human CD8+ effector T cells against human CD70-transfected CHO cells was measured in an 18 hour 51-chromium release assay.
- The potency of CD70×CD3 bispecific antibody constructs in redirecting stimulated human CD8+ effector T cells against the CD70 positive human ovarian carcinoma cell line OVCAR 8 (but other CD70 positive human cell lines are also conceivable) was measured in an 18 hour 51-chromium release assay.
- The potency of CD70×CD3 bispecific antibody constructs in redirecting the T cells in unstimulated human PBMC against human CD70-transfected CHO cells was measured in a 48 hour FACS-based cytotoxicity assay.
- The potency of CD70×CD3 bispecific antibody constructs in redirecting the T cells in unstimulated human PBMC against the CD70 positive human ovarian carcinoma cell line OVCAR 8 (but other CD70 positive human cell lines are also conceivable) was measured in a 48 hour FACS-based cytotoxicity assay.
- For confirmation that the cross-reactive CD70×CD3 bispecific antibody constructs are capable of redirecting macaque T cells against macaque CD70-transfected CHO cells, a 48 hour FACS-based cytotoxicity assay was performed with a macaque T cell line as effector T cells.

Example 8.1

Chromium Release Assay with Stimulated Human T Cells

Stimulated T cells enriched for CD8+ T cells were obtained as described in the following. A petri dish (145 mm diameter, Greiner bio-one GmbH, Kremsmünster) was coated with a commercially available anti-CD3 specific antibody (OKT3, Orthoclone) in a final concentration of 1 μg/ml for 1 hour at 37° C. Unbound protein was removed by one washing step with PBS. 3-5×107 human PBMC were added to the precoated petri dish in 120 ml of RPMI 1640 with stabilized glutamine/10% FCS/IL-2 20 U/ml (Proleukin®, Chiron) and stimulated for 2 days. On the third day, the cells were collected and washed once with RPMI 1640. IL-2 was added to a final concentration of 20 U/ml and the cells were cultured again for one day in the same cell culture medium as above. CD8+ cytotoxic T lymphocytes (CTLs) were enriched by depletion of CD4+ T cells and CD56+ NK cells using Dynal-Beads according to the manufacturer's protocol.

Cyno CD70- or human CD70-transfected CHO target cells were washed twice with PBS and labeled with 11.1 MBq 51Cr in a final volume of 100 μl RPMI with 50% FCS for 60 minutes at 37° C. Subsequently, the labeled target cells were washed 3 times with 5 ml RPMI and then used in the cytotoxicity assay. The assay was performed in a 96-well plate in a total volume of 200 μl supplemented RPMI with an E:T ratio of 10:1. A starting concentration of 0.01-1 μg/ml of purified bispecific antibody construct and threefold dilutions thereof were used. Incubation time for the assay was 18 hours. Cytotoxicity was determined as relative values of released chromium in the supernatant relative to the difference of maximum lysis (addition of Triton-X) and spontaneous lysis (without effector cells). All measurements were carried out in quadruplicates. Measurement of chromium activity in the supernatants was performed in a Wizard 3" gamma counter (Perkin Elmer Life Sciences GmbH, Köln, Germany). Analysis of the results was carried out with Prism 5 for Windows (version 5.0, GraphPad Software Inc., San Diego, California, USA). EC50 values calculated by the analysis program from the sigmoidal dose response curves were used for comparison of cytotoxic activity.

Example 8.2

Potency of Redirecting Stimulated Human Effector T Cells Against Human CD70-Transfected CHO Cells The cytotoxic activity of CD70×CD3 bispecific antibody constructs according to the invention was analyzed in a 51-chromium (51Cr) release cytotoxicity assay using CHO cells transfected with human CD70 as target cells, and stimulated human CD8+ T cells as effector cells. The experiment was carried out as described in Example 8.1.

The results are shown in Table 9 for a representative number of antibody constructs in an scFc format. The CD70×CD3 (I2C) bispecific antibody constructs showed very potent cytotoxic activity against human CD70 transfected CHO cells in the sub-picomolar range.

TABLE 9

EC50 values [pM] of CD70xCD3 bispecific antibody constructs analyzed in a 51-chromium (51Cr) release cytotoxicity assay using CHO cells transfected with human CD70 as target cells, and stimulated human CD8 T cells as effector cells.

| CD70xCD3 bispecific antibody construct | EC50 [pM] |
|---|---|
| CD70-13D_CCxI2C-scFc | 0.07 |
| CD70-16D_CCxI2C-scFc | 0.005 |
| CD70-21D_CCxI2C-scFc | 0.06 |
| CD70-24D_CCxI2C-scFc | 0.15 |
| CD70-25D_CCxI2C-scFc | 0.01 |
| CD70_1-G2D_CCxI2C-scFc | 0.01 |
| CD70-27D_CCxI2C-scFc | 0.08 |
| CD70-28D_CCxI2C-scFc | 0.03 |
| CD70-31D_CCxI2C-scFc | 0.11 |
| CD70-32D_CCxI2C-scFc | 0.08 |
| CD70-42D_CCxI2C-scFc | 0.05 |
| CD70-43D_CCxI2C-scFc | 0.08 |
| CD70-48D_CCxI2C-scFc | 0.01 |
| CD70-62D_CCxI2C-scFc | 0.02 |
| CD70-13D_CCxI2C-scFc | 0.05 |

Example 8.3

Potency of Redirecting Stimulated Human Effector T Cells Against a CD70 Positive Human Cell Line The cytotoxic activity of CD70×CD3 bispecific antibody constructs was analyzed in a 51-chromium (51Cr) release cytotoxicity assay using the CD70 positive human ovarian carcinoma cell line OVCAR 8 as source of target cells, and stimulated human CD8+ T cells as effector cells. The assay was carried out as described in Example 8.1.

The results are shown in Table 10 for a representative number of antibody constructs in an scFc format. In accordance with the results of the 51-chromium release assays with stimulated enriched human CD8+ T lymphocytes as effector cells and human CD70-transfected CHO cells as target cells, the CD70×CD3 bispecific antibody constructs of the present invention are also very potent in cytotoxic activity against natural expresser target cells with a cytotoxic activity against natural expresser cells in the sub-picomolar range.

TABLE 10

EC50 values [pM] of CD70xCD3 (I2C) bispecific antibody constructs analyzed in an 18-hour 51-chromium (51Cr) release cytotoxicity assay with the CD70-positive human ovarian carcinoma cell line OVCAR 8 as source of target cells, and stimulated enriched human CD8 T cells as effector cells.

| CD70xCD3 bispecific antibody construct | EC50 [pM] |
|---|---|
| CD70-13D_CCxI2C-scFc | 0.14 |
| CD70-16D_CCxI2C-scFc | 0.06 |
| CD70-21D_CCxI2C-scFc | 0.10 |
| CD70-24D_CCxI2C-scFc | 1.39 |
| CD70-25D_CCxI2C-scFc | 0.24 |

TABLE 10-continued

EC50 values [pM] of CD70xCD3 (I2C) bispecific antibody constructs analyzed in an 18-hour 51-chromium (51Cr) release cytotoxicity assay with the CD70-positive human ovarian carcinoma cell line OVCAR 8 as source of target cells, and stimulated enriched human CD8 T cells as effector cells.

| CD70xCD3 bispecific antibody construct | EC50 [pM] |
|---|---|
| CD70_1-G2D_CCxI2C-scFc | 0.12 |
| CD70-27D_CCxI2C-scFc | 1.35 |
| CD70-28D_CCxI2C-scFc | 0.49 |
| CD70-31D_CCxI2C-scFc | 0.64 |
| CD70-32D_CCxI2C-scFc | 0.46 |
| CD70-42D_CCxI2C-scFc | 0.84 |
| CD70-43D_CCxI2C-scFc | 0.67 |
| CD70-48D_CCxI2C-scFc | 0.47 |
| CD70-62D_CCxI2C-scFc | 0.47 |
| CD70-13D_CCxI2C-scFc | 0.36 |

Example 8.4

FACS-Based Cytotoxicity Assay with Unstimulated Human PBMC

Isolation of Effector Cells

Human peripheral blood mononuclear cells (PBMC) were prepared by Ficoll density gradient centrifugation from enriched lymphocyte preparations (buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM NH4Cl, 10 mM KHCO3, 100 μM EDTA). Platelets were removed via the supernatant upon centrifugation of PBMC at 100×g. Remaining lymphocytes mainly encompass B and T lymphocytes, NK cells and monocytes. PBMC were kept in culture at 37° C./5% $CO_2$ in RPMI medium (Gibco) with 10% FCS (Gibco).

Depletion of CD14+ and CD56+ Cells

For depletion of CD14+ cells, human CD14 MicroBeads (Milteny Biotec, MACS, #130-050-201) were used, for depletion of NK cells human CD56 MicroBeads (MACS, #130-050-401). PBMC were counted and centrifuged for 10 min at room temperature with 300×g. The supernatant was discarded and the cell pellet resuspended in MACS isolation buffer [80 μL/107 cells; PBS (Invitrogen, #20012-043), 0.5% (v/v) FBS (Gibco, #10270-106), 2 mM EDTA (Sigma-Aldrich, #E-6511)]. CD14 MicroBeads and CD56 MicroBeads (20 μL/107 cells) were added and incubated for 15 min at 4-8° C. The cells were washed with MACS isolation buffer (1-2 mL/107 cells). After centrifugation (see above), supernatant was discarded and cells resuspended in MACS isolation buffer (500 μL/108 cells). CD14/CD56 negative cells were then isolated using LS Columns (Miltenyi Biotec, #130-042-401). PBMC w/o CD14+/CD56+ cells were cultured in RPMI complete medium i.e. RPMI1640 (Biochrom AG, #FG1215) supplemented with 10% FBS (Biochrom AG, #S0115), 1× non-essential amino acids (Biochrom AG, #K0293), 10 mM Hepes buffer (Biochrom AG, #L1613), 1 mM sodium pyruvate (Biochrom AG, #L0473) and 100 U/mL penicillin/streptomycin (Biochrom AG, #A2213) at 37° C. in an incubator until needed.

Target Cell Labeling

For the analysis of cell lysis in flow cytometry assays, the fluorescent membrane dye DiOC18 (DiO) (Molecular Probes, #V22886) was used to label human CD70- or macaque CD70-transfected CHO cells as target cells and distinguish them from effector cells. Briefly, cells were harvested, washed once with PBS and adjusted to 106 cell/mL in PBS containing 2% (v/v) FBS and the membrane dye DiO (5 μL/106 cells). After incubation for 3 min at 37° C., cells were washed twice in complete RPMI medium and the cell number adjusted to 1.25×105 cells/mL. The vitality of cells was determined using 0.5% (v/v) isotonic EosinG solution (Roth, #45380).

Flow Cytometry Based Analysis

This assay was designed to quantify the lysis of cyno or human CD70-transfected CHO cells in the presence of serial dilutions of CD70 bispecific antibody constructs. Equal volumes of DiO-labeled target cells and effector cells (i.e., PBMC w/o CD14+ cells) were mixed, resulting in an E:T cell ratio of 10:1. 160 μl of this suspension were transferred to each well of a 96-well plate. 40 μL of serial dilutions of the CD70×CD3 bispecific antibody constructs and a negative control bispecific (a CD3-based bispecific antibody construct recognizing an irrelevant target antigen) or RPMI complete medium as an additional negative control were added. The bispecific antibody-mediated cytotoxic reaction proceeded for 48 hours in a 7% CO2 humidified incubator. Then cells were transferred to a new 96-well plate and loss of target cell membrane integrity was monitored by adding propidium iodide (PI) at a final concentration of 1 μg/mL. PI is a membrane impermeable dye that normally is excluded from viable cells, whereas dead cells take it up and become identifiable by fluorescent emission.

Samples were measured by flow cytometry on a FACSCanto II instrument and analyzed by FACSDiva software (both from Becton Dickinson). Target cells were identified as DiO-positive cells. PI-negative target cells were classified as living target cells. Percentage of cytotoxicity was calculated according to the following formula:

$$\text{Cytotoxicity [\%]} = \frac{n_{dead\ target\ cells}}{n_{target\ cells}} \times 100$$

$n$ = number of events

Using GraphPad Prism 5 software (Graph Pad Software, San Diego), the percentage of cytotoxicity was plotted against the corresponding bispecific antibody construct concentrations. Dose response curves were analyzed with the four parametric logistic regression models for evaluation of sigmoid dose response curves with fixed hill slope and EC50 values were calculated.

Example 8.5

Potency of Redirecting Unstimulated Human PBMC Against Human CD70-Transfected CHO Cells The cytotoxic activity of CD70×CD3 bispecific antibody constructs was analyzed in a FACS-based cytotoxicity assay using CHO cells transfected with human CD70 as target cells, and unstimulated human PBMC as effector cells. The assay was carried out as described in Example 8.4 above. In a further approach, soluble CD27 was added in a concentration of 1 ng/ml, in order to verify whether the presence of the soluble form of CD27 would impair the cytotoxic activity of the tested antibody constructs.

The results of the FACS-based cytotoxicity assays are shown in Table 11 for a representative number of antibody constructs in an scFc format with unstimulated human PBMC as effector cells and human CD70-transfected CHO cells as targets. The EC50 values were not significantly influenced by the presence of CD27. See also FIG. 6 which shows the results for the construct CD70-21D_CC×I2C-scFc.

TABLE 11

EC50 values [pM] of CD70xCD3 (I2C) bispecific antibody constructs as measured in a 48-hour FACS-based cytotoxicity assay with unstimulated human PBMC as effector cells and CHO cells transfected with human CD70 as target cells.

| CD70xCD3 bispecific antibody construct | EC50 [pM] w/o sCD27 | EC50 [pM] w/1 ng/ml sCD27 |
|---|---|---|
| CD70-13D_CCxI2C-scFc | 0.21 | 0.21 |
| CD70-16D_CCxI2C-scFc | 0.27 | 0.18 |
| CD70-21D_CCxI2C-scFc | 0.22 | 0.17 |
| CD70-24D_CCxI2C-scFc | 0.32 | 0.43 |
| CD70-25D_CCxI2C-scFc | 0.29 | 0.21 |
| CD70_1-G2D_CCxI2C-scFc | 0.49 | 0.25 |
| CD70-27D_CCxI2C-scFc | 0.49 | 0.29 |
| CD70-28D_CCxI2C-scFc | 0.19 | 0.20 |
| CD70-31D_CCxI2C-scFc | 0.48 | 0.60 |
| CD70-32D_CCxI2C-scFc | 0.26 | 0.24 |
| CD70-42D_CCxI2C-scFc | 0.29 | 0.23 |
| CD70-43D_CCxI2C-scFc | 0.22 | 0.15 |
| CD70-48D_CCxI2C-scFc | 0.26 | 0.29 |
| CD70-62D_CCxI2C-scFc | 0.35 | 0.21 |
| CD70-13D_CCxI2C-scFc | 0.25 | 0.18 |

Expectedly, EC50 values were generally higher in cytotoxicity assays with unstimulated PBMC as effector cells compared with cytotoxicity assays using stimulated human CD8+ T cells (see Example 8.2).

Example 8.6

Potency of Redirecting Unstimulated Human PBMC Against a CD70 Positive Human Ovarian Carcinoma Cell Line The cytotoxic activity of CD70×CD3 bispecific antibody constructs was furthermore analyzed in a FACS-based cytotoxicity assay using the CD70 positive human ovarian carcinoma cell line OVCAR 8 as a source of target cells and unstimulated human PBMC as effector cells. The assay was carried out as described in Example 8.4 above. The results are shown in Table 12 for a representative number of antibody constructs in an scFc format.

TABLE 12

EC50 values [pM] of CD70xCD3 (I2C) bispecific antibody constructs as measured in a 48-hour FACS-based cytotoxicity assay with unstimulated human PBMC as effector cells and the human cell line SHP-77 as source of target cells.

| CD70xCD3 bispecific antibody construct | EC50 [pM] |
|---|---|
| CD70-13D_CCxI2C-scFc | 0.07 |
| CD70-16D_CCxI2C-scFc | 0.10 |
| CD70-21D_CCxI2C-scFc | 0.06 |
| CD70-24D_CCxI2C-scFc | 0.50 |
| CD70-25D_CCxI2C-scFc | 0.05 |
| CD70_1-G2D_CCxI2C-scFc | 0.08 |
| CD70-27D_CCxI2C-scFc | 0.56 |
| CD70-28D_CCxI2C-scFc | 0.12 |
| CD70-31D_CCxI2C-scFc | 1.03 |
| CD70-32D_CCxI2C-scFc | 0.06 |
| CD70-42D_CCxI2C-scFc | 0.13 |

TABLE 12-continued

EC50 values [pM] of CD70xCD3 (I2C) bispecific antibody constructs as measured in a 48-hour FACS-based cytotoxicity assay with unstimulated human PBMC as effector cells and the human cell line SHP-77 as source of target cells.

| CD70xCD3 bispecific antibody construct | EC50 [pM] |
|---|---|
| CD70-43D_CCxI2C-scFc | 0.14 |
| CD70-48D_CCxI2C-scFc | 0.14 |
| CD70-62D_CCxI2C-scFc | 0.26 |
| CD70-13D_CCxI2C-scFc | 0.09 |

Example 8.7

Potency of Redirecting Macaque T Cells Against Macaque CD70-Expressing CHO Cells Finally, the cytotoxic activity of CD70×CD3 bispecific antibody constructs was analyzed in a FACS-based cytotoxicity assay using CHO cells transfected with macaque (cyno) CD70 as target cells, and the macaque T cell line 4119LnPx (Knappe et al. Blood 95:3256-61 (2000)) as source of effector cells. Target cell labeling of macaque CD70-transfected CHO cells and flow cytometry based analysis of cytotoxic activity was performed as described above.

Results are shown in Table 13 for a representative number of antibody constructs in an scFc format. Macaque T cells from cell line 4119LnPx were induced to efficiently kill macaque CD70-transfected CHO cells by CD70×CD3 (I2C) bispecific antibody constructs according to the invention. The antibody constructs presented potently with sub-picomolar EC50-values in this assay, confirming that they are very active in the macaque system.

TABLE 13

EC50 values [pM] of CD70xCD3 bispecific antibody constructs as measured in a 48-hour FACS-based cytotoxicity assay with macaque T cell line 4119LnPx as effector cells and CHO cells transfected with macaque CD70 as target cells.

| CD70xCD3 bispecific antibody construct | EC50 [pM] |
|---|---|
| CD70-13D_CCxI2C-scFc | 0.07 |
| CD70-16D_CCxI2C-scFc | 0.03 |
| CD70-21D_CCxI2C-scFc | 0.03 |
| CD70-24D_CCxI2C-scFc | 0.14 |
| CD70-25D_CCxI2C-scFc | 0.03 |
| CD70_1-G2D_CCxI2C-scFc | 0.03 |
| CD70-27D_CCxI2C-scFc | 0.12 |
| CD70-28D CCxI2C-scFc | 0.08 |
| CD70-31D_CCxI2C-scFc | 0.23 |
| CD70-32D_CCxI2C-scFc | 0.03 |
| CD70-42D_CCxI2C-scFc | 0.05 |
| CD70-43D_CCxI2C-scFc | 0.07 |
| CD70-48D_CCxI2C-scFc | 0.04 |
| CD70-62D_CCxI2C-scFc | 0.04 |
| CD70-13D_CCxI2C-scFc | 0.06 |

Example 9

Monomer to Dimer Conversion after (i) Three Freeze/Thaw Cycles and (ii) 7 Days of Incubation at 250 μg/ml Bispecific CD70×CD3 antibody monomeric construct was subjected to different stress conditions followed by high performance SEC to determine the percentage of initially monomeric antibody construct, which had been converted into dimeric antibody construct.

(i) 25 μg of monomeric antibody construct were adjusted to a concentration of 250 μg/ml with generic formulation buffer and then frozen at −80° C. for 30 min followed by thawing for 30 min at room temperature. After three freeze/thaw cycles the dimer content was determined by HP-SEC.

(ii) 25 μg of monomeric antibody construct were adjusted to a concentration of 250 μg/ml with generic formulation buffer followed by incubation at 37° C. for 7 days. The dimer content was determined by HP-SEC.

A high resolution SEC Column TSK Gel G3000 SWXL (Tosoh, Tokyo-Japan) was connected to an Äkta Purifier 10 FPLC (GE Lifesciences) equipped with an A905 Autosampler. Column equilibration and running buffer consisted of 100 mM KH2PO4-200 mM Na2SO4 adjusted to pH 6.6. The antibody solution (25 pg protein) was applied to the equilibrated column and elution was carried out at a flow rate of 0.75 ml/min at a maximum pressure of 7 MPa. The whole run was monitored at 280, 254 and 210 nm optical absorbance. Analysis was done by peak integration of the 210 nm signal recorded in the Äkta Unicorn software run evaluation sheet. Dimer content was calculated by dividing the area of the dimer peak by the total area of monomer plus dimer peak.

The results are shown in Table 14 for a representative number of antibody constructs in an scFc format. The CD70×CD3 (I2C) bispecific antibody constructs of the invention presented with dimer percentages of ≤1.5% (with most of the constructs presenting with a dimer percentage of ≤1.0%) after three freeze/thaw cycles, and with dimer percentages of ≤0.6% (with most of the constructs presenting with a dimer percentage of 0%) after 7 days of incubation at 37° C.

TABLE 14

Percentage of monomeric versus dimeric CD70xCD3 bispecific antibody constructs as determined by High Performance Size Exclusion Chromatography (HP-SEC).

| CD70xCD3 bispecific antibody construct | Percentage of dimer after 7 days of incubation at 37° C. | Percentage of dimer after three freeze/thaw cycles |
|---|---|---|
| CD70-13D_CCxI2C-scFc | 0.1 | 0.4 |
| CD70-16D_CCxI2C-scFc | 0.0 | 0.0 |
| CD70-21D_CCxI2C-scFc | 0.0 | 0.2 |
| CD70-24D_CCxI2C-scFc | 0.3 | 1.1 |
| CD70-25D_CCxI2C-scFc | 0.3 | 0.2 |
| CD70_1-G2D_CCxI2C-scFc | 0.0 | 0.4 |
| CD70-27D_CCxI2C-scFc | 0.0 | 1.5 |
| CD70-28D_CCxI2C-scFc | 0.3 | 0.1 |
| CD70-31D_CCxI2C-scFc | 0.0 | 1.5 |
| CD70-32D_CCxI2C-scFc | 0.0 | 0.8 |
| CD70-42D_CCxI2C-scFc | 0.0 | 0.3 |
| CD70-43D_CCxI2C-scFc | 0.0 | 0.4 |
| CD70-48D_CCxI2C-scFc | 0.6 | 0.5 |
| CD70-62D_CCxI2C-scFc | 0.0 | 0.8 |
| CD70-13D_CCxI2C-scFc | 0.0 | 0.7 |

Example 10

Thermostability

Antibody aggregation temperature was determined as follows: 40 μl of antibody construct solution at 250 μg/ml were transferred into a single use cuvette and placed in a Wyatt Dynamic Light Scattering device DynaPro Nanostar (Wyatt). The sample was heated from 40° C. to 70° C. at a heating rate of 0.5° C./min with constant acquisition of the measured radius. Increase of radius indicating melting of the protein and aggregation was used by the software package delivered with the DLS device to calculate the aggregation temperature of the antibody construct.

All tested CD70×CD3 (I2C) bispecific antibody constructs of the invention showed thermal stability with aggregation temperatures a 52.0° C., as shown in Table 15 below for a representative number of antibody constructs in an scFc format.

TABLE 15

Thermostability of the CD70xCD3 bispecific antibody constructs as determined by DLS (dynamic light scattering)

| CD70xCD3 bispecific antibody construct | Thermostability (DLS ° C. aggregation) |
|---|---|
| CD70-13D_CCxI2C-scFc | 52.4 |
| CD70-16D_CCxI2C-scFc | 57.7 |
| CD70-21D_CCxI2C-scFc | 57.3 |
| CD70-24D_CCxI2C-scFc | 57.4 |
| CD70-25D_CCxI2C-scFc | 57.6 |
| CD70_1-G2D_CCxI2C-scFc | 57.7 |
| CD70-27D_CCxI2C-scFc | 57.5 |
| CD70-28D_CCxI2C-scFc | 57.5 |
| CD70-31D_CCxI2C-scFc | 56.4 |
| CD70-32D_CCxI2C-scFc | 57.7 |
| CD70-42D_CCxI2C-scFc | 57.6 |
| CD70-43D_CCxI2C-scFc | 57.2 |
| CD70-48D_CCxI2C-scFc | 56.7 |
| CD70-62D_CCxI2C-scFc | 55.5 |
| CD70-13D_CCxI2C-scFc | 57.7 |

Example 11

Stability after Incubation for 24 Hours in Human Plasma

Purified bispecific antibody constructs were incubated at a ratio of 1:5 in a human plasma pool at 37° C. for 96 hours at a final concentration of 2-20 µg/ml. After plasma incubation the antibody constructs were compared in a 51-chromium release assay with stimulated enriched human CD8+ T cells and human CD70-transfected CHO cells at a starting concentration of 0.01-0.1 µg/ml and with an effector to target cell (E:T) ratio of 10:1 (assay as described in Example 8.1). Non-incubated, freshly thawed bispecific antibody constructs were included as controls.

The results are shown in Table 16 for a representative number of antibody constructs in an scFc format. Most tested antibody constructs had a very favourable plasma stability (EC50 plasma/EC50 control) of ≤3.0 or ≤2.5.

TABLE 16

EC50 values of the CD70xCD3 (I2C) antibody constructs with and without plasma incubation and calculated plasma/control value

| CD70xCD3 bispecific antibody construct | $EC_{50}$ [pM] w/ plasma | $EC_{50}$ [pM] w/o plasma | Plasma to Control ratio ($EC_{50}$ plasma/ $EC_{50}$ control) |
|---|---|---|---|
| CD70-13D_CCxI2C-scFc | 0.06 | 0.07 | 0.8 |
| CD70-16D_CCxI2C-scFc | 0.01 | 0.005 | 1.8 |
| CD70-21D_CCxI2C-scFc | 0.05 | 0.06 | 0.9 |
| CD70-24D_CCxI2C-scFc | n.a. | 0.15 | n.a. |
| CD70-25D_CCxI2C-scFc | 0.00 | 0.01 | 0.2 |
| CD70_1-G2D_CCxI2C-scFc | 0.07 | 0.01 | 6.8 |
| CD70-27D_CCxI2C-scFc | 0.08 | 0.08 | 1.1 |
| CD70-28D_CCxI2C-scFc | 0.01 | 0.03 | 0.5 |
| CD70-31D_CCxI2C-scFc | 0.18 | 0.11 | 1.6 |
| CD70-32D_CCxI2C-scFc | 0.03 | 0.08 | 0.4 |
| CD70-42D_CCxI2C-scFc | 0.07 | 0.05 | 1.4 |
| CD70-43D_CCxI2C-scFc | 0.11 | 0.08 | 1.4 |

TABLE 16-continued

EC50 values of the CD70xCD3 (I2C) antibody constructs with and without plasma incubation and calculated plasma/control value

| CD70xCD3 bispecific antibody construct | $EC_{50}$ [pM] w/ plasma | $EC_{50}$ [pM] w/o plasma | Plasma to Control ratio ($EC_{50}$ plasma/ $EC_{50}$ control) |
|---|---|---|---|
| CD70-48D_CCxI2C-scFc | 0.03 | 0.01 | 3.0 |
| CD70-62D_CCxI2C-scFc | 0.05 | 0.02 | 2.2 |
| CD70-13D_CCxI2C-scFc | 0.02 | 0.05 | 0.3 |

Example 12

Turbidity at 2500 µg/ml Antibody Concentration 1 ml of purified antibody construct solution of a concentration of 250 µg/ml was concentrated by spin concentration units to 2500 µg/ml. After 16 h storage at 5° C. the turbidity of the antibody solution was determined by OD340 nm optical absorption measurement against the generic formulation buffer.

The results are shown in Table 17 for a representative number of CD70×CD3 (I2C) antibody constructs in an scFc format. All tested antibody constructs have a very favourable turbidity of ≤0.05.

TABLE 17

Turbidity of the antibody constructs after concentration to 2.5 mg/ml over night

| CD70xCD3 bispecific antibody construct | Turbidity at 2500 µg/ml [OD340] |
|---|---|
| CD70-13D_CCxI2C-scFc | 0.023 |
| CD70-16D_CCxI2C-scFc | 0.017 |
| CD70-21D_CCxI2C-scFc | 0.015 |
| CD70-24D_CCxI2C-scFc | 0.019 |
| CD70-25D_CCxI2C-scFc | 0.027 |
| CD70_1-G2D_CCxI2C-scFc | 0.022 |
| CD70-27D_CCxI2C-scFc | 0.034 |
| CD70-28D_CCxI2C-scFc | 0.011 |
| CD70-31D_CCxI2C-scFc | 0.015 |
| CD70-32D_CCxI2C-scFc | 0.024 |
| CD70-42D_CCxI2C-scFc | 0.019 |
| CD70-43D_CCxI2C-scFc | 0.023 |
| CD70-48D_CCxI2C-scFc | 0.023 |
| CD70-62D_CCxI2C-scFc | 0.031 |
| CD70-13D_CCxI2C-scFc | 0.017 |

Example 13

Protein Homogeneity by High Resolution Cation Exchange Chromatography

The protein homogeneity the antibody constructs of the invention was analyzed by high resolution cation exchange chromatography CIEX. [00388]50 µg of antibody construct monomer were diluted with 50 ml binding buffer A (20 mM sodium dihydrogen phosphate, 30 mM NaCl, 0.01% sodium octanate, pH 5.5), and 40 ml of this solution were applied to a 1 ml BioPro SP-F column (YMC, Germany) connected to an Äkta Micro FPLC device (GE Healthcare, Germany). After sample binding, a wash step with further binding buffer was carried out. For protein elution, a linear increasing salt gradient using buffer B (20 mM sodium dihydrogen phosphate, 1000 mM NaCl, 0.01% sodium octanate, pH 5.5) up to 50% percent buffer B was applied over 10 column volumes. The whole run was monitored at 280, 254 and 210 nm optical absorbance. Analysis was done by peak integration of the 280 nm signal recorded in the Äkta Unicorn software run evaluation sheet.

The results are shown in Table 18 for a representative number of CD70×CD3 (I2C) antibody constructs in an scFc format. All tested antibody constructs have a favourable homogeneity of ≥60% (area under the curve (=AUC) of the main peak), nine out of 15 constructs have a homogeneity of ≥70%.

TABLE 18

Protein homogeneity of the antibody constructs (% AUC of main peak)

| CD70xCD3 bispecific antibody construct | Protein homogeneity % AUC of main peak |
|---|---|
| CD70-13D_CCxI2C-scFc | 81 |
| CD70-16D_CCxI2C-scFc | 79 |
| CD70-21D_CCxI2C-scFc | 74 |
| CD70-24D_CCxI2C-scFc | 73 |
| CD70-25D_CCxI2C-scFc | 71 |
| CD70_1-G2D_CCxI2C-scFc | 69 |
| CD70-27D_CCxI2C-scFc | 70 |
| CD70-28D_CCxI2C-scFc | 67 |
| CD70-31D_CCxI2C-scFc | 68 |
| CD70-32D_CCxI2C-scFc | 76 |
| CD70-42D_CCxI2C-scFc | 67 |
| CD70-43D_CCxI2C-scFc | 62 |
| CD70-48D_CCxI2C-scFc | 70 |
| CD70-62D_CCxI2C-scFc | 66 |
| CD70-13D_CCxI2C-scFc | 73 |

Example 14

Surface Hydrophobicity as Measured by HIC Butyl

The surface hydrophobicity of bispecific antibody constructs of the invention was tested in Hydrophobic Interaction Chromatography HIC in flow-through mode.

50 μg of antibody construct monomer were diluted with generic formulation buffer to a final volume of 500 μl (10 mM citric acid, 75 mM lysine HCl, 4% trehalose, pH 7.0) and applied to a 1 ml Butyl Sepharose FF column (GE Healthcare, Germany) connected to a Äkta Purifier FPLC system (GE Healthcare, Germany). The whole run was monitored at 280, 254 and 210 nm optical absorbance. Analysis was done by peak integration of the 280 nm signal recorded in the Äkta Unicom software run evaluation sheet. Elution behavior was evaluated by comparing area and velocity of rise and decline of protein signal thereby indicating the strength of interaction of the BiTE albumin fusion with the matrix.

A representative number of CD70×CD3 (I2C) antibody constructs in an scFc format was analysed and shown to have a good elution behaviour, which was mostly rapid and complete.

Example 15

Potency Gap Between the Monomeric and the Dimeric Isoform of Bispecific Antibody Constructs In order to determine the difference in cytotoxic activity between the monomeric and the dimeric isoform of individual CD70×CD3 bispecific antibody constructs (referred to as potency gap), an 18 hour 51-chromium release cytotoxicity assay was carried out as described hereinabove (Example 8.1) with purified bispecific antibody construct monomer and dimer. Effector cells were stimulated enriched human CD8+ T cells. Target cells were hu CD70 transfected CHO cells. Effector to target cell (E:T) ratio was 10:1. The potency gap was calculated as ratio between EC50 values.

Results are shown in Table 19 for a representative number of antibody constructs in an scFc format. Potency gaps of the tested CD70×CD3 (I2C) bispecific antibody constructs were between 0.0 and 1.5. There is hence no substantially more active dimer compared to its respective monomer.

TABLE 19

Potency gap between the monomeric and the dimeric isoform

| CD70xCD3 bispecific antibody construct | $EC_{50}$ [pM] Monomer | $EC_{50}$ [pM] dimer | Ratio $EC_{50}$ monomer/ $EC_{50}$ dimer |
|---|---|---|---|
| CD70-13D_CCxI2C-scFc | 0.07 | 0.11 | 0.6 |
| CD70-16D_CCxI2C-scFc | 0.005 | 0.07 | 0.1 |
| CD70-21D_CCxI2C-scFc | 0.06 | 0.04 | 1.5 |
| CD70-24D_CCxI2C-scFc | 0.15 | 0.24 | 0.6 |
| CD70-25D_CCxI2C-scFc | 0.01 | 0.09 | 0.1 |
| CD70_1-G2D_CCxI2C-scFc | 0.01 | 0.06 | 0.2 |
| CD70-27D_CCxI2C-scFc | 0.08 | 0.25 | 0.3 |
| CD70-28D_CCxI2C-scFc | 0.03 | 0.09 | 0.3 |
| CD70-31D_CCxI2C-scFc | 0.11 | 0.24 | 0.5 |
| CD70-32D_CCxI2C-scFc | 0.08 | 0.23 | 0.3 |
| CD70-42D_CCxI2C-scFc | 0.05 | 70 | 0.0 |
| CD70-43D_CCxI2C-scFc | 0.08 | 0.20 | 0.4 |
| CD70-48D_CCxI2C-scFc | 0.01 | 0.09 | 0.1 |
| CD70-62D_CCxI2C-scFc | 0.02 | 0.17 | 0.1 |
| CD70-13D_CCxI2C-scFc | 0.05 | 0.12 | 0.4 |

Example 16

CD27 does not Inhibit Binding of Anti-CD70 scFv Molecules

This assay was carried out to test whether the soluble form of CD27 (136-458 μg/ml soluble CD27 in human serum; Huang J. et al. (2013) J Immunol 190:1-9) would impair binding of the anti-CD70 binding domains according to the invention to CD70.

To verify binding of human CD27 to CHO cells transfected with human CD70, cells were incubated with human CD27 for 30 minutes at 4° C. (1 μg/ml; R&D #382-CD-100). Bound CD27 was detected with an anti-HIS antibody (5 μg/ml; AbD Serotec) followed by an anti-mouse IgG Fc-gamma-PE (1:100; Jackson Immunoresearch #115-116-071). As negative control cells were incubated with PBS/2% FCS instead of CD27.

To test replacement of anti-CD70 scFv by CD27, CHO cells transfected with human CD70 were incubated with or without CD27 for 30 minutes at 4° C. (1 μg/ml; R&D #382-CD-100). Afterwards cells were washed twice and then stained with crude, undiluted periplasmic extract containing scFv binding to CD70. Bound scFv was detected with mouse monoclonal anti-FLAG M2 antibody (1 μg/ml; Sigma F1804) followed by an anti-mouse IgG Fc-gamma- PE (1:100; Jackson Immunoresearch #115-116-071). As negative control, cells were incubated with an unspecific scFv instead of anti-CD70 scFv. CD27 and all antibodies were diluted in PBS with 2% FCS.

No competition between soluble CD27 and the anti-CD70 scFv was observed for any of the CD70 binders of the present invention that were analyzed.

Lengthy table referenced here

US12790401-20261110-T00001

Please refer to the end of the specification for access instructions.

LENGTHY TABLES

The patent contains a lengthy table section. A copy of the table is available in electronic form from the USPTO web site (https://seqdata.uspto.gov/docdetail?docId=US12790401B2). An electronic copy of the table will also be available from the USPTO upon request and payment of the fee set forth in 37 CFR 1.19(b)(3).

SEQUENCE LISTING (1883 sequences)

SEQ ID NO: 1 - protein, 5 aa, Artificial Sequence
  Synthetic peptide
TYGMH

SEQ ID NO: 2 - protein, 17 aa, Artificial Sequence
  Synthetic peptide
VIWYDGSNKYYGDSVKG

SEQ ID NO: 3 - protein, 11 aa, Artificial Sequence
  Synthetic peptide
DNSHYYYGMDV

SEQ ID NO: 4 - protein, 14 aa, Artificial Sequence
  Synthetic peptide
TGSSSNIGAGYDVN

SEQ ID NO: 5 - protein, 7 aa, Artificial Sequence
  Synthetic peptide
VNNNRPS

SEQ ID NO: 6 - protein, 11 aa, Artificial Sequence
  Synthetic peptide
QSYDTSLSASV

SEQ ID NO: 7 - protein, 120 aa, Artificial Sequence
  Synthetic peptide
QVQLVESGGGVVQPGRSLRLSCAASGFTFSTYGMHWVRQAPGKGLEWVAVIWYDGSNKYYGDSVKGRFTISRDNSKNTLYLQMNSLRAEDTAVYYCARDNSHYYYGMDVWGQGTTVTVSS

SEQ ID NO: 8 - protein, 111 aa, Artificial Sequence
  Synthetic peptide
QSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVL

SEQ ID NO: 9 - protein, 247 aa, Artificial Sequence
  Synthetic peptide
QVQLVESGGGVVQPGRSLRLSCAASGFTFSTYGMHWVRQAPGKGLEWVAVIWYDGSNKYYGDSVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLS

SEQ ID NO: 10 - protein, 501 aa, Artificial Sequence
  Synthetic peptide
QVQLVESGGGVVQPGRSLRLSCAASGFTFSTYGMHWVRQAPGKGLEWVAVIWYDGSNKYYGDSVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 11 - protein, 5 aa, Artificial Sequence
  Synthetic peptide
SYGMH

SEQ ID NO: 12 - protein, 17 aa, Artificial Sequence
  Synthetic peptide
VIWYDGSDKYFADSVKG

SEQ ID NO: 13 - protein, 13 aa, Artificial Sequence
  Synthetic peptide
DGIAGARYVYFDY

SEQ ID NO: 14 - protein, 11 aa, Artificial Sequence
  Synthetic peptide
RASQGISNYLA

SEQ ID NO: 15 - protein, 7 aa, Artificial Sequence
  Synthetic peptide
AASSLQG

SEQ ID NO: 16 - protein, 9 aa, Artificial Sequence
  Synthetic peptide
QQYYNYPFT

SEQ ID NO: 17 - protein, 122 aa, Artificial Sequence
  Synthetic peptide
QVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSS

SEQ ID NO: 18 - protein, 107 aa, Artificial Sequence
  Synthetic peptide
DIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIK

SEQ ID NO: 19 - protein, 244 aa, Artificial Sequence
  Synthetic peptide
QVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIK

SEQ ID NO: 20 - protein, 499 aa, Artificial Sequence
  Synthetic peptide
QVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 21 - protein, 5 aa, Artificial Sequence
  Synthetic peptide
SYGMH

SEQ ID NO: 22 - protein, 17 aa, Artificial Sequence
  Synthetic peptide
VTWYDGSNKYYGDSVKG

SEQ ID NO: 23 - protein, 13 aa, Artificial Sequence
  Synthetic peptide
DLLRGVKGYAMDV

SEQ ID NO: 24 - protein, 12 aa, Artificial Sequence
  Synthetic peptide
RASQSLRRIYLA

SEQ ID NO: 25 - protein, 7 aa, Artificial Sequence
  Synthetic peptide
DVFDRAT

SEQ ID NO: 26 - protein, 9 aa, Artificial Sequence
  Synthetic peptide
QQYSDSPFT

SEQ ID NO: 27 - protein, 122 aa, Artificial Sequence
  Synthetic peptide
QEQLVESGGGVVQPGRSLRLSCAASGFTFSSYGMHWVRQAPGKGLEWVAVTWYDGSNKYYGDSVKGRFTISRDNSKNTLYLQMNSLRAEDTAVYYCARDLLRGVKGYAMDVWGQGTTVTVSS

SEQ ID NO: 28 - protein, 108 aa, Artificial Sequence
  Synthetic peptide
EIVLTQSPGTLSLSPGERATLSCRASQSLRRIYLAWYQQKPGQAPRLLIYDVFDRATGIPDRFSGGGSGTDFTLTISRLEPEDFAVYYCQQYSDSPFTFGPGTKVDIK

SEQ ID NO: 29 - protein, 245 aa, Artificial Sequence
  Synthetic peptide
QEQLVESGGGVVQPGRSLRLSCAASGFTFSSYGMHWVRQAPGKGLEWVAVTWYDGSNKYYGDSVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSDSPFTFGPGTKVDIK

SEQ ID NO: 30 - protein, 500 aa, Artificial Sequence
  Synthetic peptide
QEQLVESGGGVVQPGRSLRLSCAASGFTFSSYGMHWVRQAPGKGLEWVAVTWYDGSNKYYGDSVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSDSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 31 - protein, 5 aa, Artificial Sequence
  Synthetic peptide
SYGIS

SEQ ID NO: 32 - protein, 17 aa, Artificial Sequence
  Synthetic peptide
WISAYNGYTHYAQKLQG

SEQ ID NO: 33 - protein, 12 aa, Artificial Sequence
  Synthetic peptide
DYGGNDYYGMDV

SEQ ID NO: 34 - protein, 13 aa, Artificial Sequence
  Synthetic peptide
SGSSSNIGINYVY

SEQ ID NO: 35 - protein, 7 aa, Artificial Sequence
  Synthetic peptide
RSDQRPS

SEQ ID NO: 36 - protein, 11 aa, Artificial Sequence
  Synthetic peptide
AAWDDSLSGVV

SEQ ID NO: 37 - protein, 121 aa, Artificial Sequence
  Synthetic peptide
QVQLVQSGAEVKKPGASVKVSCKASGYTFTSYGISWVRQAPGQGLEWMGWISAYNGYTHYAQKLQGRVTMTTDTSTSTAYMELRSLRSDDTAVYYCARDYGGNDYYGMDVWGQGTTVTVSS

SEQ ID NO: 38 - protein, 110 aa, Artificial Sequence
  Synthetic peptide
QSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGGGTKLTVL

SEQ ID NO: 39 - protein, 246 aa, Artificial Sequence
  Synthetic peptide
QVQLVQSGAEVKKPGASVKVSCKASGYTFTSYGISWVRQAPGQGLEWMGWISAYNGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGGGTKLTVL

SEQ ID NO: 40 - protein, 501 aa, Artificial Sequence
  Synthetic peptide
QVQLVQSGAEVKKPGASVKVSCKASGYTFTSYGISWVRQAPGQGLEWMGWISAYNGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 41 - protein, 7 aa, Artificial Sequence
  Synthetic peptide
SGGYYWS

SEQ ID NO: 42 - protein, 16 aa, Artificial Sequence
  Synthetic peptide
YIFYSGSTDYNPSLKS

SEQ ID NO: 43 - protein, 10 aa, Artificial Sequence
  Synthetic peptide
SGYSYALFDH

SEQ ID NO: 44 - protein, 11 aa, Artificial Sequence
  Synthetic peptide
RASQFIGRYFN

SEQ ID NO: 45 - protein, 7 aa, Artificial Sequence
  Synthetic peptide
AESSLQS

SEQ ID NO: 46 - protein, 9 aa, Artificial Sequence
  Synthetic peptide
QQSYSTPWT

SEQ ID NO: 47 - protein, 120 aa, Artificial Sequence
  Synthetic peptide
QVQLQESGPGLVKPSQTLSLTCTVSGDSIISGGYYWSWIRQHPGKGLEWIGYIFYSGSTDYNPSLKSRVTISVDTSKNQFSLKLSSVTAADTAVYYCARSGYSYALFDHWGQGTLVTVSS

SEQ ID NO: 48 - protein, 107 aa, Artificial Sequence
  Synthetic peptide
DIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGQGTKVEIK

SEQ ID NO: 49 - protein, 242 aa, Artificial Sequence
  Synthetic peptide
QVQLQESGPGLVKPSQTLSLTCTVSGDSIISGGYYWSWIRQHPGKGLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGQGTKVEIK

SEQ ID NO: 50 - protein, 497 aa, Artificial Sequence
  Synthetic peptide
QVQLQESGPGLVKPSQTLSLTCTVSGDSIISGGYYWSWIRQHPGKGLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 51 - protein, 7 aa, Artificial Sequence
  Synthetic peptide
SGGYYWS

SEQ ID NO: 52 - protein, 16 aa, Artificial Sequence
  Synthetic peptide
YIFYSGSTDYNPSLKS

SEQ ID NO: 53 - protein, 10 aa, Artificial Sequence
  Synthetic peptide
SGYSYALFDH

SEQ ID NO: 54 - protein, 11 aa, Artificial Sequence
  Synthetic peptide
RASQFIGRYFN

SEQ ID NO: 55 - protein, 7 aa, Artificial Sequence
  Synthetic peptide
AESSLQS

SEQ ID NO: 56 - protein, 9 aa, Artificial Sequence
  Synthetic peptide
QQSYSTPFT

SEQ ID NO: 57 - protein, 120 aa, Artificial Sequence
  Synthetic peptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSS

SEQ ID NO: 58 - protein, 107 aa, Artificial Sequence
  Synthetic peptide
DIQMTQSPSSLSASVGDRVTISCRASQFIGRYFNWYQQQPGKAPKVLIYAESSLQSGVPSRFSGSGSGTEFTLTISSLQPEDFARYYCQQSYSTPFTFGCGTKVEIK

SEQ ID NO: 59 - protein, 242 aa, Artificial Sequence
  Synthetic peptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPFTFGCGTKVEIK

SEQ ID NO: 60 - protein, 497 aa, Artificial Sequence
  Synthetic peptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 61 - protein, 5 aa, Artificial Sequence
  Synthetic peptide
SYYLH

SEQ ID NO: 62 - protein, 17 aa, Artificial Sequence
  Synthetic peptide
IVDPSGGSTSYDQKFQG

SEQ ID NO: 63 - protein, 9 aa, Artificial Sequence
  Synthetic peptide
DYGDYVFDY

SEQ ID NO: 64 - protein, 13 aa, Artificial Sequence
  Synthetic peptide
SGSSSNIGTNTVN

SEQ ID NO: 65 - protein, 7 aa, Artificial Sequence
  Synthetic peptide
INNQRPS

SEQ ID NO: 66 - protein, 11 aa, Artificial Sequence
  Synthetic peptide
ATWDDSLNGPV

SEQ ID NO: 67 - protein, 118 aa, Artificial Sequence
  Synthetic peptide
QVHLVQSGAEVKKPGASVRVSCKASGYTFTSYYLHWVRQAPGQCLEWMGIVDPSGGSTSYDQKFQGRFTMTRDTSTSTVYMELSSLRSEDTAVYYCARDYGDYVFDYWGQGTLVTVSS

SEQ ID NO: 68 - protein, 110 aa, Artificial Sequence
  Synthetic peptide
QSVLTQPPSASGTPGQRVTISCSGSSSNIGTNTVNWYQQLPGTAPQLLIYINNQRPSGVPDRFSGSKSGTSASLAISGLQSEDEADYYCATWDDSLNGPVVGCGTKLTVL

SEQ ID NO: 69 - protein, 243 aa, Artificial Sequence
  Synthetic peptide
QVHLVQSGAEVKKPGASVRVSCKASGYTFTSYYLHWVRQAPGQCLEWMGIVDPSGGSTSYDQKFQGRFTMTRDTSTSTVYMELSSLRSEDTAVYYCARDYGDYVFDYWGQGTLVTVSSGGGGSGGGGSGGGGSQSVLTQPPSASGTPGQRVTISCSGSSSNIGTNTVNWYQQLPGTAPQLLIYINNQRPSGVPDRFSGSKSGTSASLAISGLQSEDEADYYCATWDDSLNGPVVGCGTKLTVL

SEQ ID NO: 70 - protein, 498 aa, Artificial Sequence
  Synthetic peptide
QVHLVQSGAEVKKPGASVRVSCKASGYTFTSYYLHWVRQAPGQCLEWMGIVDPSGGSTSYDQKFQGRFTMTRDTSTSTVYMELSSLRSEDTAVYYCARDYGDYVFDYWGQGTLVTVSSGGGGSGGGGSGGGGSQSVLTQPPSASGTPGQRVTISCSGSSSNIGTNTVNWYQQLPGTAPQLLIYINNQRPSGVPDRFSGSKSGTSASLAISGLQSEDEADYYCATWDDSLNGPVVGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 71 - protein, 5 aa, Artificial Sequence
  Synthetic peptide
SYGMH

SEQ ID NO: 72 - protein, 17 aa, Artificial Sequence
  Synthetic peptide
VIWYDGSDKYFADSVKG

SEQ ID NO: 73 - protein, 13 aa, Artificial Sequence
  Synthetic peptide
DGIAGARYVYFDY

SEQ ID NO: 74 - protein, 11 aa, Artificial Sequence
  Synthetic peptide
RASQGISNYLA

SEQ ID NO: 75 - protein, 7 aa, Artificial Sequence
  Synthetic peptide
AASSLQG

SEQ ID NO: 76 - protein, 9 aa, Artificial Sequence
  Synthetic peptide
QQYYNYPFT

SEQ ID NO: 77 - protein, 122 aa, Artificial Sequence
  Synthetic peptide
QVQLVESGGGVVQPGRSLRLSCAASGFTFSSYGMHWVRQAPGKCLEWVAVIWYDGSDKYFADSVKGRFTISRDNSKNTLYLQMNSLRAEDTAVYYCARDGIAGARYVYFDYWGQGTLVTVSS

SEQ ID NO: 78 - protein, 107 aa, Artificial Sequence
  Synthetic peptide
DIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGCGTTVDIK

SEQ ID NO: 79 - protein, 244 aa, Artificial Sequence
  Synthetic peptide
QVQLVESGGGVVQPGRSLRLSCAASGFTFSSYGMHWVRQAPGKCLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGCGTTVDIK

SEQ ID NO: 80 - protein, 499 aa, Artificial Sequence
  Synthetic peptide
QVQLVESGGGVVQPGRSLRLSCAASGFTFSSYGMHWVRQAPGKCLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGCGTTVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 81 - protein, 5 aa, Artificial Sequence
  Synthetic peptide
SYGIS

SEQ ID NO: 82 - protein, 17 aa, Artificial Sequence
  Synthetic peptide
WISAYNGYTHYAQKLQG

SEQ ID NO: 83 - protein, 12 aa, Artificial Sequence
  Synthetic peptide
DYGGNDYYGMDV

SEQ ID NO: 84 - protein, 13 aa, Artificial Sequence
  Synthetic peptide
SGSSSNIGINYVY

SEQ ID NO: 85 - protein, 7 aa, Artificial Sequence
  Synthetic peptide
RSDQRPS

SEQ ID NO: 86 - protein, 11 aa, Artificial Sequence
  Synthetic peptide
AAWDDSLSGVV

SEQ ID NO: 87 - protein, 121 aa, Artificial Sequence
  Synthetic peptide
QVQLVQSGAEVKKPGASVKVSCKASGYTFTSYGISWVRQAPGQCLEWMGWISAYNGYTHYAQKLQGRVTMTTDTSTSTAYMELRSLRSDDTAVYYCARDYGGNDYYGMDVWGQGTTVTVSS

SEQ ID NO: 88 - protein, 110 aa, Artificial Sequence
  Synthetic peptide
QSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGCGTKLTVL

SEQ ID NO: 89 - protein, 246 aa, Artificial Sequence
  Synthetic peptide
QVQLVQSGAEVKKPGASVKVSCKASGYTFTSYGISWVRQAPGQCLEWMGWISAYNGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGCGTKLTVL

SEQ ID NO: 90 - protein, 501 aa, Artificial Sequence
  Synthetic peptide
QVQLVQSGAEVKKPGASVKVSCKASGYTFTSYGISWVRQAPGQCLEWMGWISAYNGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 91 - protein, 7 aa, Artificial Sequence
  Synthetic peptide
SGGYYWS

SEQ ID NO: 92 - protein, 16 aa, Artificial Sequence
  Synthetic peptide
YIFYSGSTDYNPSLKS

SEQ ID NO: 93 - protein, 10 aa, Artificial Sequence
  Synthetic peptide
SGYSYALFDH

SEQ ID NO: 94 - protein, 11 aa, Artificial Sequence
  Synthetic peptide
RASQFIGRYFN

SEQ ID NO: 95 - protein, 7 aa, Artificial Sequence
  Synthetic peptide
AESSLQS

SEQ ID NO: 96 - protein, 9 aa, Artificial Sequence
  Synthetic peptide
QQSYSTPWT

SEQ ID NO: 97 - protein, 120 aa, Artificial Sequence; identical to SEQ ID NO: 57
  Synthetic peptide

SEQ ID NO: 98 - protein, 107 aa, Artificial Sequence
  Synthetic peptide
DIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGCGTKVEIK

SEQ ID NO: 99 - protein, 242 aa, Artificial Sequence
  Synthetic peptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGCGTKVEIK

SEQ ID NO: 100 - protein, 497 aa, Artificial Sequence
  Synthetic peptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 101 - protein, 5 aa, Artificial Sequence
  Synthetic peptide
TYGMH

SEQ ID NO: 102 - protein, 17 aa, Artificial Sequence
  Synthetic peptide
VIWYDGSNKYYGDSVKG

SEQ ID NO: 103 - protein, 11 aa, Artificial Sequence
  Synthetic peptide
DNSHYYYGMDV

SEQ ID NO: 104 - protein, 14 aa, Artificial Sequence
  Synthetic peptide
TGSSSNIGAGYDVN

SEQ ID NO: 105 - protein, 7 aa, Artificial Sequence
  Synthetic peptide
VNNNRPS

SEQ ID NO: 106 - protein, 11 aa, Artificial Sequence
  Synthetic peptide
QSYETSLSASV

SEQ ID NO: 107 - protein, 120 aa, Artificial Sequence
  Synthetic peptide
QVQLVESGGGVVQPGRSLRLSCAASGFTFSTYGMHWVRQAPGKCLEWVAVIWYDGSNKYYGDSVKGRFTISRDNSKNTLYLQMNSLRAEDTAVYYCARDNSHYYYGMDVWGQGTTVTVSS

SEQ ID NO: 108 - protein, 111 aa, Artificial Sequence
  Synthetic peptide
QSVLTQPPSVSGAPGQRVTISCTGSSSNIGAGYDVNWYQQFPGTAPKLLIYVNNNRPSGVPDRFSGSTSGTSASLAITGLQAEDEADYYCQSYETSLSASVFGCGTRLTVL

SEQ ID NO: 109 - protein, 246 aa, Artificial Sequence
  Synthetic peptide
QVQLVESGGGVVQPGRSLRLSCAASGFTFSTYGMHWVRQAPGKCLEWVAVIWYDGSNKYYGDSVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYETSLSASVFGCGTRLTVL

SEQ ID NO: 110 - protein, 501 aa, Artificial Sequence
  Synthetic peptide
QVQLVESGGGVVQPGRSLRLSCAASGFTFSTYGMHWVRQAPGKCLEWVAVIWYDGSNKYYGDSVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYETSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 111 - protein, 5 aa, Artificial Sequence
  Synthetic peptide
YYGMH

SEQ ID NO: 112 - protein, 17 aa, Artificial Sequence
  Synthetic peptide
VIWYDGSNKYYADSVKG

SEQ ID NO: 113 - protein, 12 aa, Artificial Sequence
  Synthetic peptide
DREMGSRGDFDY

SEQ ID NO: 114 - protein, 11 aa, Artificial Sequence
  Synthetic peptide
RASQGINNYLA

SEQ ID NO: 115 - protein, 7 aa, Artificial Sequence
  Synthetic peptide
AVSILQS

SEQ ID NO: 116 - protein, 9 aa, Artificial Sequence
  Synthetic peptide
QQYNFYPFS

SEQ ID NO: 117 - protein, 121 aa, Artificial Sequence
  Synthetic peptide
QAQLVESGGGVVQPGRSLRLSCAASGFTFSYYGMHWVRQAPGKCLEWVAVIWYDGSNKYYADSVKGRFTISRDNSKNTLYLQMNSLRAEDTAVYYCARDREMGSRGDFDYWGQGTLVTVSS

SEQ ID NO: 118 - protein, 107 aa, Artificial Sequence
  Synthetic peptide
DIQMTQSPSSLSASVGDRVTITCRASQGINNYLAWFQQKPGKAPKSLIYAVSILQSGVPSKFSGSGSGTDFTLTIGNLQPEDFATYYCQQYNFYPFSFGCGTKVDIK

SEQ ID NO: 119 - protein, 243 aa, Artificial Sequence
  Synthetic peptide
QAQLVESGGGVVQPGRSLRLSCAASGFTFSYYGMHWVRQAPGKCLEWVAVIWYDGSNKYYADSVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTIGNLQPEDFATYYCQQYNFYPFSFGCGTKVDIK

SEQ ID NO: 120 - protein, 498 aa, Artificial Sequence
  Synthetic peptide
QAQLVESGGGVVQPGRSLRLSCAASGFTFSYYGMHWVRQAPGKCLEWVAVIWYDGSNKYYADSVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTIGNLQPEDFATYYCQQYNFYPFSFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 121 - protein, 5 aa, Artificial Sequence
  Synthetic peptide
SYAMS

SEQ ID NO: 122 - protein, 17 aa, Artificial Sequence
  Synthetic peptide
VISGSGGRPNYADSVKG

SEQ ID NO: 123 - protein, 11 aa, Artificial Sequence
  Synthetic peptide
VDYSNYLFFDY

SEQ ID NO: 124 - protein, 12 aa, Artificial Sequence
  Synthetic peptide
RAGQSVRSSYLG

SEQ ID NO: 125 - protein, 7 aa, Artificial Sequence
  Synthetic peptide
GASSRAT

SEQ ID NO: 126 - protein, 9 aa, Artificial Sequence
  Synthetic peptide
QQYGYSPPT

SEQ ID NO: 127 - protein, 120 aa, Artificial Sequence
  Synthetic peptide
EVQLLESGGGLVQPGGSLRLSCAASGFTFSSYAMSWVRQAPGKGLEWVSVISGSGGRPNYADSVKGRFTISRDNSKNTLYLQMNSLRDEDTAVYYCAKVDYSNYLFFDYWGQGTLVTVSS

SEQ ID NO: 128 - protein, 108 aa, Artificial Sequence
  Synthetic peptide
EIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIK

SEQ ID NO: 129 - protein, 243 aa, Artificial Sequence
  Synthetic peptide
EVQLLESGGGLVQPGGSLRLSCAASGFTFSSYAMSWVRQAPGKGLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIK

SEQ ID NO: 130 - protein, 498 aa, Artificial Sequence
  Synthetic peptide
EVQLLESGGGLVQPGGSLRLSCAASGFTFSSYAMSWVRQAPGKGLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 131 - protein, 5 aa, Artificial Sequence
  Synthetic peptide
IYAMS

SEQ ID NO: 132 - protein, 17 aa, Artificial Sequence
  Synthetic peptide
AISGSGGSTFYADSVKG

SEQ ID NO: 133 - protein, 11 aa, Artificial Sequence
  Synthetic peptide
HDYSNYPYFDY

SEQ ID NO: 134 - protein, 12 aa, Artificial Sequence
  Synthetic peptide
RASQSVRSSYLA

SEQ ID NO: 135 - protein, 7 aa, Artificial Sequence
  Synthetic peptide
GASSRAT

SEQ ID NO: 136 - protein, 9 aa, Artificial Sequence
  Synthetic peptide
QQYGDLPFT

SEQ ID NO: 137 - protein, 120 aa, Artificial Sequence
  Synthetic peptide
EVQLLESGGGLVQPGGSLKLSCAASGFTFSIYAMSWVRQAPGKGLEWVSAISGSGGSTFYADSVKGRFTISRDNSKNTLYLQMNSLRAEDTAVYYCAKHDYSNYPYFDYWGQGTLVTVSS

SEQ ID NO: 138 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 139 - protein, 243 aa, Artificial Sequence
  Synthetic peptide
EVQLLESGGGLVQPGGSLKLSCAASGFTFSIYAMSWVRQAPGKGLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 140 - protein, 498 aa, Artificial Sequence
  Synthetic peptide
EVQLLESGGGLVQPGGSLKLSCAASGFTFSIYAMSWVRQAPGKGLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 141 - protein, 5 aa, Artificial Sequence
  Synthetic peptide
SYAMS

SEQ ID NO: 142 - protein, 17 aa, Artificial Sequence
  Synthetic peptide
AISGSGGRTFYADSVEG

SEQ ID NO: 143 - protein, 11 aa, Artificial Sequence
  Synthetic peptide
HDYSNYPYFDY

SEQ ID NO: 144 - protein, 12 aa, Artificial Sequence
  Synthetic peptide
RASQSVRSSYLA

SEQ ID NO: 145 - protein, 7 aa, Artificial Sequence
  Synthetic peptide
GASSRAT

SEQ ID NO: 146 - protein, 9 aa, Artificial Sequence
  Synthetic peptide
QQYGSSPFT

SEQ ID NO: 147 - protein, 120 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLFLQMNSLRAEDTAVYYCAKHDYSNYPYFDYWGQGTLVTVSS

SEQ ID NO: 148 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 149 - protein, 243 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 150 - protein, 498 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 151 - protein, 5 aa, Artificial Sequence
  Synthetic peptide
SYAMS

SEQ ID NO: 152 - protein, 17 aa, Artificial Sequence
  Synthetic peptide
AISGSGGRTFYADSVEG

SEQ ID NO: 153 - protein, 11 aa, Artificial Sequence
  Synthetic peptide
HDYSNYPYFDY

SEQ ID NO: 154 - protein, 12 aa, Artificial Sequence
  Synthetic peptide
RASQSIRSSYLA

SEQ ID NO: 155 - protein, 7 aa, Artificial Sequence
  Synthetic peptide
GASSRAT

SEQ ID NO: 156 - protein, 9 aa, Artificial Sequence
  Synthetic peptide
QQYGDLPFT

SEQ ID NO: 157 - protein, 120 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSS

SEQ ID NO: 158 - protein, 108 aa, Artificial Sequence
  Synthetic peptide
EIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIK

SEQ ID NO: 159 - protein, 243 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIK

SEQ ID NO: 160 - protein, 498 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 161 - protein, 5 aa, Artificial Sequence
  Synthetic peptide
SYAMS

SEQ ID NO: 162 - protein, 17 aa, Artificial Sequence
  Synthetic peptide
AISGSGGRTHYADSVKG

SEQ ID NO: 163 - protein, 11 aa, Artificial Sequence
  Synthetic peptide
HDYSNYPYFDY

SEQ ID NO: 164 - protein, 12 aa, Artificial Sequence
  Synthetic peptide
RASQSVRSSYLA

SEQ ID NO: 165 - protein, 7 aa, Artificial Sequence
  Synthetic peptide
GASSRAT

SEQ ID NO: 166 - protein, 9 aa, Artificial Sequence
  Synthetic peptide
QQYGSSPFT

SEQ ID NO: 167 - protein, 120 aa, Artificial Sequence
  Synthetic peptide
EVQLLESGGGLVQSGGSLRLSCAASGFTFSSYAMSWVRQAPGKGLEWVSAISGSGGRTHYADSVKGRFTISRDNSKNTLYLQMNSLRAEDTAVYYCAKHDYSNYPYFDYWGQGTLVTVSS

SEQ ID NO: 168 - protein, 108 aa, Artificial Sequence; identical to SEQ ID NO: 148
  Synthetic peptide

SEQ ID NO: 169 - protein, 243 aa, Artificial Sequence
  Synthetic peptide
EVQLLESGGGLVQSGGSLRLSCAASGFTFSSYAMSWVRQAPGKGLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 170 - protein, 498 aa, Artificial Sequence
  Synthetic peptide
EVQLLESGGGLVQSGGSLRLSCAASGFTFSSYAMSWVRQAPGKGLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 171 - protein, 5 aa, Artificial Sequence
  Synthetic peptide
SYAMS

SEQ ID NO: 172 - protein, 17 aa, Artificial Sequence
  Synthetic peptide
LISGSGGRTHYADSVKG

SEQ ID NO: 173 - protein, 11 aa, Artificial Sequence
  Synthetic peptide
HDYSNYPYFDY

SEQ ID NO: 174 - protein, 12 aa, Artificial Sequence
  Synthetic peptide
RASQSVRSTYLA

SEQ ID NO: 175 - protein, 7 aa, Artificial Sequence
  Synthetic peptide
DASSRAT

SEQ ID NO: 176 - protein, 9 aa, Artificial Sequence
  Synthetic peptide
QQYGSSPPT

SEQ ID NO: 177 - protein, 120 aa, Artificial Sequence
  Synthetic peptide
EVQLLESGGGLVQPGGSLRLSCAASGFTFSSYAMSWVRQAPGKGLEWVSLISGSGGRTHYADSVKGRFTISRDNSKNTLYLQMNSLRAEDTAVYYCAKHDYSNYPYFDYWGQGTLVTVSS

SEQ ID NO: 178 - protein, 108 aa, Artificial Sequence
  Synthetic peptide
EIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIK

SEQ ID NO: 179 - protein, 243 aa, Artificial Sequence
  Synthetic peptide
EVQLLESGGGLVQPGGSLRLSCAASGFTFSSYAMSWVRQAPGKGLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIK

SEQ ID NO: 180 - protein, 498 aa, Artificial Sequence
  Synthetic peptide
EVQLLESGGGLVQPGGSLRLSCAASGFTFSSYAMSWVRQAPGKGLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 181 - protein, 5 aa, Artificial Sequence
  Synthetic peptide
TYAMS

SEQ ID NO: 182 - protein, 17 aa, Artificial Sequence
  Synthetic peptide
AISGSGGSTFYADSVKG

SEQ ID NO: 183 - protein, 11 aa, Artificial Sequence
  Synthetic peptide
HDYSNYPYFDY

SEQ ID NO: 184 - protein, 12 aa, Artificial Sequence
  Synthetic peptide
RASQSVRSSYLA

SEQ ID NO: 185 - protein, 7 aa, Artificial Sequence
  Synthetic peptide
GASSRAT

SEQ ID NO: 186 - protein, 9 aa, Artificial Sequence
  Synthetic peptide
QQYGDLPFT

SEQ ID NO: 187 - protein, 120 aa, Artificial Sequence
  Synthetic peptide
EVQLLESGGGLVQPGGSLRLSCAASGFTFSTYAMSWVRQAPGKGLEWVSAISGSGGSTFYADSVKGRFTISRDNSKNTLSLQMNSLRAEDTAVYYCAKHDYSNYPYFDYWGQGTLVTVSS

SEQ ID NO: 188 - protein, 108 aa, Artificial Sequence; identical to SEQ ID NO: 138
  Synthetic peptide

SEQ ID NO: 189 - protein, 243 aa, Artificial Sequence
  Synthetic peptide
EVQLLESGGGLVQPGGSLRLSCAASGFTFSTYAMSWVRQAPGKGLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 190 - protein, 498 aa, Artificial Sequence
  Synthetic peptide
EVQLLESGGGLVQPGGSLRLSCAASGFTFSTYAMSWVRQAPGKGLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 191 - protein, 5 aa, Artificial Sequence
  Synthetic peptide
TYAMS

SEQ ID NO: 192 - protein, 17 aa, Artificial Sequence
  Synthetic peptide
LISGSGGRTYYADSVKG

SEQ ID NO: 193 - protein, 11 aa, Artificial Sequence
  Synthetic peptide
HDYSNYPYFDY

SEQ ID NO: 194 - protein, 12 aa, Artificial Sequence
  Synthetic peptide
RASQGVRSDYLA

SEQ ID NO: 195 - protein, 7 aa, Artificial Sequence
  Synthetic peptide
GASSRAT

SEQ ID NO: 196 - protein, 9 aa, Artificial Sequence
  Synthetic peptide
QQYGSTPPT

SEQ ID NO: 197 - protein, 120 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSS

SEQ ID NO: 198 - protein, 108 aa, Artificial Sequence
  Synthetic peptide
EIVLTQSPGTLSLSPGERATLSCRASQGVRSDYLAWYQQKPGQALRLLIYGASSRATGIPDRFSGSGSGTDFTLTISRLEPEDFAVYHCQQYGSTPPTFGGGTKLEIK

SEQ ID NO: 199 - protein, 243 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSDYLAWYQQKPGQALRLLIYGASSRATGIPDRFSGSGSGTDFTLTISRLEPEDFAVYHCQQYGSTPPTFGGGTKLEIK

SEQ ID NO: 200 - protein, 498 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSDYLAWYQQKPGQALRLLIYGASSRATGIPDRFSGSGSGTDFTLTISRLEPEDFAVYHCQQYGSTPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 201 - protein, 5 aa, Artificial Sequence
  Synthetic peptide
TYAMS

SEQ ID NO: 202 - protein, 17 aa, Artificial Sequence
  Synthetic peptide
AISGSGGRTFYADSVEG

SEQ ID NO: 203 - protein, 11 aa, Artificial Sequence
  Synthetic peptide
HDYSNYPYFDY

SEQ ID NO: 204 - protein, 12 aa, Artificial Sequence
  Synthetic peptide
RASQSVRSTYLA

SEQ ID NO: 205 - protein, 7 aa, Artificial Sequence
  Synthetic peptide
GASSRAT

SEQ ID NO: 206 - protein, 9 aa, Artificial Sequence
  Synthetic peptide
QQYGDLPFT

SEQ ID NO: 207 - protein, 120 aa, Artificial Sequence
  Synthetic peptide
EVQLLESGGGMVQPGGSLRLSCAASGFTFSTYAMSWVRQAPGKGLEWVSAISGSGGRTFYADSVEGRFTISRDNSKNTLYLQMNSLRAEDTAVYYCAKHDYSNYPYFDYWGQGTLVTVSS

SEQ ID NO: 208 - protein, 108 aa, Artificial Sequence
  Synthetic peptide
EIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIK

SEQ ID NO: 209 - protein, 243 aa, Artificial Sequence
  Synthetic peptide
EVQLLESGGGMVQPGGSLRLSCAASGFTFSTYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIK

SEQ ID NO: 210 - protein, 498 aa, Artificial Sequence
  Synthetic peptide
EVQLLESGGGMVQPGGSLRLSCAASGFTFSTYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 211 - protein, 5 aa, Artificial Sequence
  Synthetic peptide
SYAMS

SEQ ID NO: 212 - protein, 17 aa, Artificial Sequence
  Synthetic peptide
AISGSGGYTYYADSVKG

SEQ ID NO: 213 - protein, 11 aa, Artificial Sequence
  Synthetic peptide
HDYSNYPYFDY

SEQ ID NO: 214 - protein, 12 aa, Artificial Sequence
  Synthetic peptide
RASQSVRSNYLA

SEQ ID NO: 215 - protein, 7 aa, Artificial Sequence
  Synthetic peptide
GASSRAT

SEQ ID NO: 216 - protein, 9 aa, Artificial Sequence
  Synthetic peptide
QQYGDLPFT

SEQ ID NO: 217 - protein, 120 aa, Artificial Sequence
  Synthetic peptide
EVQLLESGGGLVQPGGSLRLSCAASGFTFSSYAMSWVRQAPGKGLEWVSAISGSGGYTYYADSVKGRFTISRDNSKNTLYLQMNSLRAEDTAVYYCAKHDYSNYPYFDYWGQGTLVTVSS

SEQ ID NO: 218 - protein, 108 aa, Artificial Sequence
  Synthetic peptide
EIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 219 - protein, 243 aa, Artificial Sequence
  Synthetic peptide
EVQLLESGGGLVQPGGSLRLSCAASGFTFSSYAMSWVRQAPGKGLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 220 - protein, 498 aa, Artificial Sequence
  Synthetic peptide
EVQLLESGGGLVQPGGSLRLSCAASGFTFSSYAMSWVRQAPGKGLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 221 - protein, 5 aa, Artificial Sequence
  Synthetic peptide
VYAMS

SEQ ID NO: 222 - protein, 17 aa, Artificial Sequence
  Synthetic peptide
TISDSGGSTFYADSVKG

SEQ ID NO: 223 - protein, 11 aa, Artificial Sequence
  Synthetic peptide
HDYSNYAYFDY

SEQ ID NO: 224 - protein, 12 aa, Artificial Sequence
  Synthetic peptide
RASQSVRSSYLA

SEQ ID NO: 225 - protein, 7 aa, Artificial Sequence
  Synthetic peptide
GASSRAT

SEQ ID NO: 226 - protein, 9 aa, Artificial Sequence
  Synthetic peptide
QQYGDLPFT

SEQ ID NO: 227 - protein, 120 aa, Artificial Sequence
  Synthetic peptide
EVQLLESGGGLVQPGGSLRLSCAASGFTFSVYAMSWVRQAPGKGLEWVSTISDSGGSTFYADSVKGRFTISRDNSKNTLYLQMNRLRAEDTAVYYCARHDYSNYAYFDYWGQGTLVTVSS

SEQ ID NO: 228 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 229 - protein, 243 aa, Artificial Sequence
  Synthetic peptide
EVQLLESGGGLVQPGGSLRLSCAASGFTFSVYAMSWVRQAPGKGLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 230 - protein, 498 aa, Artificial Sequence
  Synthetic peptide
EVQLLESGGGLVQPGGSLRLSCAASGFTFSVYAMSWVRQAPGKGLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 231 - protein, 5 aa, Artificial Sequence
  Synthetic peptide
SYAMS

SEQ ID NO: 232 - protein, 17 aa, Artificial Sequence
  Synthetic peptide
AISGSGGSTFYADSVKG

SEQ ID NO: 233 - protein, 11 aa, Artificial Sequence
  Synthetic peptide
HDYSNYPYFDY

SEQ ID NO: 234 - protein, 12 aa, Artificial Sequence
  Synthetic peptide
RASQSVRSSYLA

SEQ ID NO: 235 - protein, 7 aa, Artificial Sequence
  Synthetic peptide
GASSRAT

SEQ ID NO: 236 - protein, 9 aa, Artificial Sequence
  Synthetic peptide
QQYGDLPFT

SEQ ID NO: 237 - protein, 120 aa, Artificial Sequence
  Synthetic peptide
EVQLLESGGGLAQPGGSLRLSCAASGFTFSSYAMSWVRQAPGKGLEWVSAISGSGGSTFYADSVKGRFTISRDNSKNTLYLQMNSLRAEDTAVYFCAKHDYSNYPYFDYWGQGTLVTVSS

SEQ ID NO: 238 - protein, 108 aa, Artificial Sequence; identical to SEQ ID NO: 228
  Synthetic peptide

SEQ ID NO: 239 - protein, 243 aa, Artificial Sequence
  Synthetic peptide
EVQLLESGGGLAQPGGSLRLSCAASGFTFSSYAMSWVRQAPGKGLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 240 - protein, 498 aa, Artificial Sequence
  Synthetic peptide
EVQLLESGGGLAQPGGSLRLSCAASGFTFSSYAMSWVRQAPGKGLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 241 - protein, 5 aa, Artificial Sequence
  Synthetic peptide
SYAMS

SEQ ID NO: 242 - protein, 17 aa, Artificial Sequence
  Synthetic peptide
AISGSGGRTFYADSVEG

SEQ ID NO: 243 - protein, 11 aa, Artificial Sequence
  Synthetic peptide
HDYSNYPYFDY

SEQ ID NO: 244 - protein, 12 aa, Artificial Sequence
  Synthetic peptide
RASQSVRSNYLA

SEQ ID NO: 245 - protein, 7 aa, Artificial Sequence
  Synthetic peptide
GASSRAT

SEQ ID NO: 246 - protein, 9 aa, Artificial Sequence
  Synthetic peptide
QQYGDLPFT

SEQ ID NO: 247 - protein, 120 aa, Artificial Sequence; identical to SEQ ID NO: 157
  Synthetic peptide

SEQ ID NO: 248 - protein, 108 aa, Artificial Sequence; identical to SEQ ID NO: 218
  Synthetic peptide

SEQ ID NO: 249 - protein, 243 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 250 - protein, 498 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 251 - protein, 5 aa, Artificial Sequence
  Synthetic peptide
SYAMS

SEQ ID NO: 252 - protein, 17 aa, Artificial Sequence
  Synthetic peptide
AISGSGGRTFYADSVEG

SEQ ID NO: 253 - protein, 11 aa, Artificial Sequence
  Synthetic peptide
HDYSNYPYFDY

SEQ ID NO: 254 - protein, 12 aa, Artificial Sequence
  Synthetic peptide
RASQSVRSSYLA

SEQ ID NO: 255 - protein, 7 aa, Artificial Sequence
  Synthetic peptide
GASSRAT

SEQ ID NO: 256 - protein, 9 aa, Artificial Sequence
  Synthetic peptide
QQYGSSPFT

SEQ ID NO: 257 - protein, 120 aa, Artificial Sequence; identical to SEQ ID NO: 157
  Synthetic peptide

SEQ ID NO: 258 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIK

SEQ ID NO: 259 - protein, 243 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIK

SEQ ID NO: 260 - protein, 498 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 261 - protein, 5 aa, Artificial Sequence
  Synthetic peptide
TYAMS

SEQ ID NO: 262 - protein, 17 aa, Artificial Sequence
  Synthetic peptide
AISGSGGGTFYADSVKG

SEQ ID NO: 263 - protein, 11 aa, Artificial Sequence
  Synthetic peptide
HDYSNYPYFDY

SEQ ID NO: 264 - protein, 12 aa, Artificial Sequence
  Synthetic peptide
RASQSIRSNYLA

SEQ ID NO: 265 - protein, 7 aa, Artificial Sequence
  Synthetic peptide
GASSRAT

SEQ ID NO: 266 - protein, 9 aa, Artificial Sequence
  Synthetic peptide
QQYGSSPFT

SEQ ID NO: 267 - protein, 120 aa, Artificial Sequence
  Synthetic peptide
EVQLLESGGGLVQPGGSLRLSCAASGFTFSTYAMSWVRQAPGKGLEWVSAISGSGGGTFYADSVKGRFTISRDNSKNTLYLQMNSLRAEDTAVYYCAKHDYSNYPYFDYWGQGTLVTVSS

SEQ ID NO: 268 - protein, 108 aa, Artificial Sequence
  Synthetic peptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIK

SEQ ID NO: 269 - protein, 243 aa, Artificial Sequence
  Synthetic peptide
EVQLLESGGGLVQPGGSLRLSCAASGFTFSTYAMSWVRQAPGKGLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIK

SEQ ID NO: 270 - protein, 498 aa, Artificial Sequence
  Synthetic peptide
EVQLLESGGGLVQPGGSLRLSCAASGFTFSTYAMSWVRQAPGKGLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 271 - protein, 5 aa, Artificial Sequence
  Synthetic peptide
TYAMS

SEQ ID NO: 272 - protein, 17 aa, Artificial Sequence
  Synthetic peptide
LISGSGGRTYYADSVKG

SEQ ID NO: 273 - protein, 11 aa, Artificial Sequence
  Synthetic peptide
HDYSNYPYFDY

SEQ ID NO: 274 - protein, 12 aa, Artificial Sequence
  Synthetic peptide
RASQSVRSNYLA

SEQ ID NO: 275 - protein, 7 aa, Artificial Sequence
  Synthetic peptide
GASNRAT

SEQ ID NO: 276 - protein, 9 aa, Artificial Sequence
  Synthetic peptide
QQYGISPPT

SEQ ID NO: 277 - protein, 120 aa, Artificial Sequence; identical to SEQ ID NO: 197
  Synthetic peptide

SEQ ID NO: 278 - protein, 108 aa, Artificial Sequence
  Synthetic peptide
EIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIK

SEQ ID NO: 279 - protein, 243 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIK

SEQ ID NO: 280 - protein, 498 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 281 - protein, 5 aa, Artificial Sequence
  Synthetic peptide
SYAMS

SEQ ID NO: 282 - protein, 17 aa, Artificial Sequence
  Synthetic peptide
VISGSGGRTHYADSGKG

SEQ ID NO: 283 - protein, 11 aa, Artificial Sequence
  Synthetic peptide
HDYSNYPYFDY

SEQ ID NO: 284 - protein, 12 aa, Artificial Sequence
  Synthetic peptide
RASQSVRSSYLA

SEQ ID NO: 285 - protein, 7 aa, Artificial Sequence
  Synthetic peptide
GASSRAT

SEQ ID NO: 286 - protein, 9 aa, Artificial Sequence
  Synthetic peptide
EQYGNSPPT

SEQ ID NO: 287 - protein, 120 aa, Artificial Sequence
  Synthetic peptide
EVQLLESGGGLVQPGGSLRLSCAASGFNFASYAMSWVRQAPGKGLEWVSVISGSGGRTHYADSGKGRFTISRDNSKNTLYLQMNSLRAEDTAVYYCAKHDYSNYPYFDYWGQGTLVTVSS

SEQ ID NO: 288 - protein, 108 aa, Artificial Sequence
  Synthetic peptide
EIVLTQSPGTLSLSPGERATLSCRASQSVRSSYLAWYQQKPGQAPRLLIFGASSRATGIPDRFSGSESGTDFTLTINRLEPEDFAVYYCEQYGNSPPTFGGGTKVEIK

SEQ ID NO: 289 - protein, 243 aa, Artificial Sequence
  Synthetic peptide
EVQLLESGGGLVQPGGSLRLSCAASGFNFASYAMSWVRQAPGKGLEWVSVISGSGGRTHYADSGKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIFGASSRATGIPDRFSGSESGTDFTLTINRLEPEDFAVYYCEQYGNSPPTFGGGTKVEIK

SEQ ID NO: 290 - protein, 498 aa, Artificial Sequence
  Synthetic peptide
EVQLLESGGGLVQPGGSLRLSCAASGFNFASYAMSWVRQAPGKGLEWVSVISGSGGRTHYADSGKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIFGASSRATGIPDRFSGSESGTDFTLTINRLEPEDFAVYYCEQYGNSPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 291 - protein, 5 aa, Artificial Sequence
  Synthetic peptide
TYAMS

SEQ ID NO: 292 - protein, 17 aa, Artificial Sequence
  Synthetic peptide
LISGSGGRTYYADSVKG

SEQ ID NO: 293 - protein, 11 aa, Artificial Sequence
  Synthetic peptide
HDYSNYPYFDY

SEQ ID NO: 294 - protein, 12 aa, Artificial Sequence
  Synthetic peptide
RASQSVRSSYLA

SEQ ID NO: 295 - protein, 7 aa, Artificial Sequence
  Synthetic peptide
GASSRAT

SEQ ID NO: 296 - protein, 9 aa, Artificial Sequence
  Synthetic peptide
QQYGSSPPP

SEQ ID NO: 297 - protein, 120 aa, Artificial Sequence
  Synthetic peptide
EVQLLESGGGVVQPGRSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSS

SEQ ID NO: 298 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPPFGGGTKVEIK

SEQ ID NO: 299 - protein, 243 aa, Artificial Sequence
  Synthetic peptide
EVQLLESGGGVVQPGRSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPPFGGGTKVEIK

SEQ ID NO: 300 - protein, 498 aa, Artificial Sequence
  Synthetic peptide
EVQLLESGGGVVQPGRSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 301 - protein, 5 aa, Artificial Sequence
  Synthetic peptide
SYAMS

SEQ ID NO: 302 - protein, 17 aa, Artificial Sequence
  Synthetic peptide
AISGSGGRAQYADSVQG

SEQ ID NO: 303 - protein, 11 aa, Artificial Sequence
  Synthetic peptide
HDYSNYPYFDY

SEQ ID NO: 304 - protein, 11 aa, Artificial Sequence
  Synthetic peptide
RASQSVSSNLA

SEQ ID NO: 305 - protein, 7 aa, Artificial Sequence
  Synthetic peptide
GSSSRAT

SEQ ID NO: 306 - protein, 9 aa, Artificial Sequence
  Synthetic peptide
QQYGSSPPP

SEQ ID NO: 307 - protein, 120 aa, Artificial Sequence
  Synthetic peptide
EVQLLESGGGLVQPGGSLRLSCAASGFTFSSYAMSWVRQSPGKGLEWVSAISGSGGRAQYADSVQGRFTVSRDNSKNTLYLQMNSLRAEDTAVYYCAKHDYSNYPYFDYWGQGTLVTVSS

SEQ ID NO: 308 - protein, 107 aa, Artificial Sequence
  Synthetic peptide
EIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIK

SEQ ID NO: 309 - protein, 242 aa, Artificial Sequence
  Synthetic peptide
EVQLLESGGGLVQPGGSLRLSCAASGFTFSSYAMSWVRQSPGKGLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIK

SEQ ID NO: 310 - protein, 497 aa, Artificial Sequence
  Synthetic peptide
EVQLLESGGGLVQPGGSLRLSCAASGFTFSSYAMSWVRQSPGKGLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 311 - protein, 5 aa, Artificial Sequence
  Synthetic peptide
SYAMS

SEQ ID NO: 312 - protein, 17 aa, Artificial Sequence
  Synthetic peptide
AISGSGGRTFYADSVEG

SEQ ID NO: 313 - protein, 11 aa, Artificial Sequence
  Synthetic peptide
HDYSNYPYFDY

SEQ ID NO: 314 - protein, 12 aa, Artificial Sequence
  Synthetic peptide
RASQGVRSDYLA

SEQ ID NO: 315 - protein, 7 aa, Artificial Sequence
  Synthetic peptide
GASSRAT

SEQ ID NO: 316 - protein, 9 aa, Artificial Sequence
  Synthetic peptide
QQYGSTPPT

SEQ ID NO: 317 - protein, 120 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSS

SEQ ID NO: 318 - protein, 108 aa, Artificial Sequence
  Synthetic peptide
EIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIK

SEQ ID NO: 319 - protein, 243 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIK

SEQ ID NO: 320 - protein, 498 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 321 - protein, 5 aa, Artificial Sequence
  Synthetic peptide
TYAMS

SEQ ID NO: 322 - protein, 17 aa, Artificial Sequence
  Synthetic peptide
TISDSGGSTFYADSVMG

SEQ ID NO: 323 - protein, 11 aa, Artificial Sequence
  Synthetic peptide
HDYSNYAFFDY

SEQ ID NO: 324 - protein, 11 aa, Artificial Sequence
  Synthetic peptide
RASQSVSSNLA

SEQ ID NO: 325 - protein, 7 aa, Artificial Sequence
  Synthetic peptide
GASSRAT

SEQ ID NO: 326 - protein, 9 aa, Artificial Sequence
  Synthetic peptide
QQYYSTPFT

SEQ ID NO: 327 - protein, 120 aa, Artificial Sequence
  Synthetic peptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSS

SEQ ID NO: 328 - protein, 107 aa, Artificial Sequence
  Synthetic peptide
EIVLTQSPATLSVSPGERATLSCRASQSVSSNLAWYQQKPGQAPRLLIYGASSRATGIPDRFSGSGSGTDFTLTISSLQAEDVAVYYCQQYYSTPFTFGPGTKVEIK

SEQ ID NO: 329 - protein, 242 aa, Artificial Sequence
  Synthetic peptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSSGGGGSGGGGSGGGGSEIVLTQSPATLSVSPGERATLSCRASQSVSSNLAWYQQKPGQAPRLLIYGASSRATGIPDRFSGSGSGTDFTLTISSLQAEDVAVYYCQQYYSTPFTFGPGTKVEIK

SEQ ID NO: 330 - protein, 497 aa, Artificial Sequence
  Synthetic peptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSSGGGGSGGGGSGGGGSEIVLTQSPATLSVSPGERATLSCRASQSVSSNLAWYQQKPGQAPRLLIYGASSRATGIPDRFSGSGSGTDFTLTISSLQAEDVAVYYCQQYYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 331 - protein, 5 aa, Artificial Sequence
  Synthetic peptide
TYAMS

SEQ ID NO: 332 - protein, 17 aa, Artificial Sequence
  Synthetic peptide
TISDSGGSTFYADSVMG

SEQ ID NO: 333 - protein, 11 aa, Artificial Sequence
  Synthetic peptide
HDYSNYAFFDY

SEQ ID NO: 334 - protein, 11 aa, Artificial Sequence
  Synthetic peptide
RASQSVSSNLA

SEQ ID NO: 335 - protein, 7 aa, Artificial Sequence
  Synthetic peptide
GASTRAT

SEQ ID NO: 336 - protein, 9 aa, Artificial Sequence
  Synthetic peptide
QQYYSTPFT

SEQ ID NO: 337 - protein, 120 aa, Artificial Sequence; identical to SEQ ID NO: 327
  Synthetic peptide

SEQ ID NO: 338 - protein, 107 aa, Artificial Sequence
  Synthetic peptide
EIVLTQSPATLSVSPGERATLSCRASQSVSSNLAWYQQKPGQAPRLLIYGASTRATGIPARFSGSGSGTEFTLAISRLEPEDFAVYYCQQYYSTPFTFGGGTKVEIK

SEQ ID NO: 339 - protein, 242 aa, Artificial Sequence
  Synthetic peptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSSGGGGSGGGGSGGGGSEIVLTQSPATLSVSPGERATLSCRASQSVSSNLAWYQQKPGQAPRLLIYGASTRATGIPARFSGSGSGTEFTLAISRLEPEDFAVYYCQQYYSTPFTFGGGTKVEIK

SEQ ID NO: 340 - protein, 497 aa, Artificial Sequence
  Synthetic peptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSSGGGGSGGGGSGGGGSEIVLTQSPATLSVSPGERATLSCRASQSVSSNLAWYQQKPGQAPRLLIYGASTRATGIPARFSGSGSGTEFTLAISRLEPEDFAVYYCQQYYSTPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 341 - protein, 5 aa, Artificial Sequence
  Synthetic peptide
TYAMS

SEQ ID NO: 342 - protein, 17 aa, Artificial Sequence
  Synthetic peptide
AISGSGGYTYYADSVEG

SEQ ID NO: 343 - protein, 11 aa, Artificial Sequence
  Synthetic peptide
HDYSNYAWFDP

SEQ ID NO: 344 - protein, 12 aa, Artificial Sequence
  Synthetic peptide
RASQSVSSAYLA

SEQ ID NO: 345 - protein, 7 aa, Artificial Sequence
  Synthetic peptide
GASSRAT

SEQ ID NO: 346 - protein, 9 aa, Artificial Sequence
  Synthetic peptide
QQFGSSPFT

SEQ ID NO: 347 - protein, 120 aa, Artificial Sequence
  Synthetic peptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSS

SEQ ID NO: 348 - protein, 108 aa, Artificial Sequence
  Synthetic peptide
EIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGPGTKVEIK

SEQ ID NO: 349 - protein, 243 aa, Artificial Sequence
  Synthetic peptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSSGGGGSGGGGSGGGGSEIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGPGTKVEIK

SEQ ID NO: 350 - protein, 498 aa, Artificial Sequence
  Synthetic peptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSSGGGGSGGGGSGGGGSEIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 351 - protein, 5 aa, Artificial Sequence
  Synthetic peptide
SYAMS

SEQ ID NO: 352 - protein, 17 aa, Artificial Sequence
  Synthetic peptide
AISGSGGRTYYADSVKG

SEQ ID NO: 353 - protein, 11 aa, Artificial Sequence
  Synthetic peptide
HDYSNYPYFDY

SEQ ID NO: 354 - protein, 12 aa, Artificial Sequence
  Synthetic peptide
RASQSVRGSYLA

SEQ ID NO: 355 - protein, 7 aa, Artificial Sequence
  Synthetic peptide
SASSRAT

SEQ ID NO: 356 - protein, 9 aa, Artificial Sequence
  Synthetic peptide
QQYGDSPFT

SEQ ID NO: 357 - protein, 120 aa, Artificial Sequence
  Synthetic peptide
EVQLLESGGGLVQPGGSLRLSCAASGFTFSSYAMSWVRQAPGQGLEWVSAISGSGGRTYYADSVKGRFTISRDNSKNTLYLQMNSLRAEDTAVYYCAKHDYSNYPYFDYWGQGTLVTVSS

SEQ ID NO: 358 - protein, 108 aa, Artificial Sequence
  Synthetic peptide
EIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGPGTKVEIK

SEQ ID NO: 359 - protein, 243 aa, Artificial Sequence
  Synthetic peptide
EVQLLESGGGLVQPGGSLRLSCAASGFTFSSYAMSWVRQAPGQGLEWVSAISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGPGTKVEIK

SEQ ID NO: 360 - protein, 498 aa, Artificial Sequence
  Synthetic peptide
EVQLLESGGGLVQPGGSLRLSCAASGFTFSSYAMSWVRQAPGQGLEWVSAISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 361 - protein, 5 aa, Artificial Sequence
  Synthetic peptide
SYAMS

SEQ ID NO: 362 - protein, 17 aa, Artificial Sequence
  Synthetic peptide
AIGDGGGYTYYADSVKG

SEQ ID NO: 363 - protein, 11 aa, Artificial Sequence
  Synthetic peptide
HDYSNYPYFDY

SEQ ID NO: 364 - protein, 12 aa, Artificial Sequence
  Synthetic peptide
RASQGVRSSYFA

SEQ ID NO: 365 - protein, 7 aa, Artificial Sequence
  Synthetic peptide
GASTRAT

SEQ ID NO: 366 - protein, 9 aa, Artificial Sequence
  Synthetic peptide
QQYGSSPPT

SEQ ID NO: 367 - protein, 120 aa, Artificial Sequence
  Synthetic peptide
EVQLLESGGGLVQPGGSLRLSCAASGFTFSSYAMSWVRQAPGKGLEWVSAIGDGGGYTYYADSVKGRFTISRDNSKNTLSLLMNSLRAEDTAVYYCARHDYSNYPYFDYWGQGTLVTVSS

SEQ ID NO: 368 - protein, 108 aa, Artificial Sequence
  Synthetic peptide
EIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIK

SEQ ID NO: 369 - protein, 243 aa, Artificial Sequence
  Synthetic peptide
EVQLLESGGGLVQPGGSLRLSCAASGFTFSSYAMSWVRQAPGKGLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIK

SEQ ID NO: 370 - protein, 498 aa, Artificial Sequence
  Synthetic peptide
EVQLLESGGGLVQPGGSLRLSCAASGFTFSSYAMSWVRQAPGKGLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 371 - protein, 5 aa, Artificial Sequence
  Synthetic peptide
SYAMS

SEQ ID NO: 372 - protein, 17 aa, Artificial Sequence
  Synthetic peptide
AISGSGGRTFYADSVEG

SEQ ID NO: 373 - protein, 11 aa, Artificial Sequence
  Synthetic peptide
HDYSNYPYFDY

SEQ ID NO: 374 - protein, 12 aa, Artificial Sequence
  Synthetic peptide
RASQSIRSNYLA

SEQ ID NO: 375 - protein, 7 aa, Artificial Sequence
  Synthetic peptide
GASSRAT

SEQ ID NO: 376 - protein, 9 aa, Artificial Sequence
  Synthetic peptide
QQYGSSPPS

SEQ ID NO: 377 - protein, 120 aa, Artificial Sequence
  Synthetic peptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSS

SEQ ID NO: 378 - protein, 108 aa, Artificial Sequence
  Synthetic peptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIK

SEQ ID NO: 379 - protein, 243 aa, Artificial Sequence
  Synthetic peptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIK

SEQ ID NO: 380 - protein, 498 aa, Artificial Sequence
  Synthetic peptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 381 - protein, 5 aa, Artificial Sequence
  Synthetic peptide
SYAMS

SEQ ID NO: 382 - protein, 17 aa, Artificial Sequence
  Synthetic peptide
AISGSGGGTFYADSVEG

SEQ ID NO: 383 - protein, 11 aa, Artificial Sequence
  Synthetic peptide
HDYSNYPYFDY

SEQ ID NO: 384 - protein, 12 aa, Artificial Sequence
  Synthetic peptide
RASQSVRSSYLA

SEQ ID NO: 385 - protein, 7 aa, Artificial Sequence
  Synthetic peptide
GASSRAT

SEQ ID NO: 386 - protein, 9 aa, Artificial Sequence
  Synthetic peptide
QQYGDLPFT

SEQ ID NO: 387 - protein, 120 aa, Artificial Sequence
  Synthetic peptide
EVQLLESGGGVVQPGRSLRLSCAASGFTFSSYAMSWVRQAPGKGLEWVSAISGSGGGTFYADSVEGRFTISRDNSKNTLYLQMNSLRAEDTAVYYCARHDYSNYPYFDYWGLGTLVTVSS

SEQ ID NO: 388 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIK

SEQ ID NO: 389 - protein, 243 aa, Artificial Sequence
  Synthetic peptide
EVQLLESGGGVVQPGRSLRLSCAASGFTFSSYAMSWVRQAPGKGLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIK

SEQ ID NO: 390 - protein, 498 aa, Artificial Sequence
  Synthetic peptide
EVQLLESGGGVVQPGRSLRLSCAASGFTFSSYAMSWVRQAPGKGLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 391 - protein, 5 aa, Artificial Sequence
  Synthetic peptide
SYAMS

SEQ ID NO: 392 - protein, 17 aa, Artificial Sequence
  Synthetic peptide
AISGSGGRTFYADSVEG

SEQ ID NO: 393 - protein, 11 aa, Artificial Sequence
  Synthetic peptide
HDYSNYPYFDY

SEQ ID NO: 394 - protein, 12 aa, Artificial Sequence
  Synthetic peptide
RASQSIRSSYLA

SEQ ID NO: 395 - protein, 7 aa, Artificial Sequence
  Synthetic peptide
GASSRAT

SEQ ID NO: 396 - protein, 9 aa, Artificial Sequence
  Synthetic peptide
QQYGDLPFT

SEQ ID NO: 397 - protein, 120 aa, Artificial Sequence; identical to SEQ ID NO: 157
  Synthetic peptide

SEQ ID NO: 398 - protein, 108 aa, Artificial Sequence
  Synthetic peptide
EIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKVDIK

SEQ ID NO: 399 - protein, 243 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKVDIK

SEQ ID NO: 400 - protein, 498 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 401 - protein, 5 aa, Artificial Sequence
  Synthetic peptide
SYAMS

SEQ ID NO: 402 - protein, 17 aa, Artificial Sequence
  Synthetic peptide
AISGSGGRTFYADSVEG

SEQ ID NO: 403 - protein, 11 aa, Artificial Sequence
  Synthetic peptide
HDYSNYPYFDY

SEQ ID NO: 404 - protein, 12 aa, Artificial Sequence
  Synthetic peptide
RASQSVRSSYLA

SEQ ID NO: 405 - protein, 7 aa, Artificial Sequence
  Synthetic peptide
GASSRAT

SEQ ID NO: 406 - protein, 9 aa, Artificial Sequence
  Synthetic peptide
QQYGDLPFT

SEQ ID NO: 407 - protein, 120 aa, Artificial Sequence; identical to SEQ ID NO: 317
  Synthetic peptide

SEQ ID NO: 408 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIK

SEQ ID NO: 409 - protein, 243 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIK

SEQ ID NO: 410 - protein, 498 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 411 - protein, 5 aa, Artificial Sequence
  Synthetic peptide
TYAMS

SEQ ID NO: 412 - protein, 17 aa, Artificial Sequence
  Synthetic peptide
LISGSGGRTYYADSVKG

SEQ ID NO: 413 - protein, 11 aa, Artificial Sequence
  Synthetic peptide
HDYSNYPYFDY

SEQ ID NO: 414 - protein, 12 aa, Artificial Sequence
  Synthetic peptide
RASQGVRSSYLA

SEQ ID NO: 415 - protein, 7 aa, Artificial Sequence
  Synthetic peptide
GASSRAT

SEQ ID NO: 416 - protein, 9 aa, Artificial Sequence
  Synthetic peptide
QQYGSSPPT

SEQ ID NO: 417 - protein, 120 aa, Artificial Sequence; identical to SEQ ID NO: 197
  Synthetic peptide

SEQ ID NO: 418 - protein, 108 aa, Artificial Sequence
  Synthetic peptide
EIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIK

SEQ ID NO: 419 - protein, 243 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIK

SEQ ID NO: 420 - protein, 498 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 421 - protein, 5 aa, Artificial Sequence
  Synthetic peptide
SYAMS

SEQ ID NO: 422 - protein, 17 aa, Artificial Sequence
  Synthetic peptide
AISGSGGRTFYADSVEG

SEQ ID NO: 423 - protein, 11 aa, Artificial Sequence
  Synthetic peptide
HDYSNYPYFDY

SEQ ID NO: 424 - protein, 12 aa, Artificial Sequence
  Synthetic peptide
RASQSVRSNYLA

SEQ ID NO: 425 - protein, 7 aa, Artificial Sequence
  Synthetic peptide
GASSRAT

SEQ ID NO: 426 - protein, 9 aa, Artificial Sequence
  Synthetic peptide
QQYGSSPPT

SEQ ID NO: 427 - protein, 120 aa, Artificial Sequence; identical to SEQ ID NO: 377
  Synthetic peptide

SEQ ID NO: 428 - protein, 108 aa, Artificial Sequence
  Synthetic peptide
EIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIK

SEQ ID NO: 429 - protein, 243 aa, Artificial Sequence
  Synthetic peptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIK

SEQ ID NO: 430 - protein, 498 aa, Artificial Sequence
  Synthetic peptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 431 - protein, 5 aa, Artificial Sequence
  Synthetic peptide
SYAMS

SEQ ID NO: 432 - protein, 17 aa, Artificial Sequence
  Synthetic peptide
VISDSGGITDFADSVKG

SEQ ID NO: 433 - protein, 11 aa, Artificial Sequence
  Synthetic peptide
HDYSNYFFFDY

SEQ ID NO: 434 - protein, 11 aa, Artificial Sequence
  Synthetic peptide
RASQDISNYLN

SEQ ID NO: 435 - protein, 7 aa, Artificial Sequence
  Synthetic peptide
AASSLQS

SEQ ID NO: 436 - protein, 9 aa, Artificial Sequence
  Synthetic peptide
QQSYISPPT

SEQ ID NO: 437 - protein, 120 aa, Artificial Sequence
  Synthetic peptide
EVQLLESGGGLVQPGGSLRLSCAASGFTFSSYAMSWVRQAPGKGLEWVSVISDSGGITDFADSVKGRFIISRDNSRNTLYLQMNSLRAEDTAVYFCARHDYSNYFFFDYWGQGTLVTVSS

SEQ ID NO: 438 - protein, 107 aa, Artificial Sequence
  Synthetic peptide
DIQMTQSPSSLSASVGDRVTITCRASQDISNYLNWYQQKSGKAPELLIYAASSLQSGVPSRFSGSGSGTDFTLTISSLQPEDFATYYCQQSYISPPTFGQGTKVEIK

SEQ ID NO: 439 - protein, 242 aa, Artificial Sequence
  Synthetic peptide
EVQLLESGGGLVQPGGSLRLSCAASGFTFSSYAMSWVRQAPGKGLEWVSVISDSGGITDFADSVKGRFIISRDNSRNTLYLQMNSLRAEDTAVYFCARHDYSNYFFFDYWGQGTLVTVSSGGGGSGGGGSGGGGSDIQMTQSPSSLSASVGDRVTITCRASQDISNYLNWYQQKSGKAPELLIYAASSLQSGVPSRFSGSGSGTDFTLTISSLQPEDFATYYCQQSYISPPTFGQGTKVEIK

SEQ ID NO: 440 - protein, 497 aa, Artificial Sequence
  Synthetic peptide
EVQLLESGGGLVQPGGSLRLSCAASGFTFSSYAMSWVRQAPGKGLEWVSVISDSGGITDFADSVKGRFIISRDNSRNTLYLQMNSLRAEDTAVYFCARHDYSNYFFFDYWGQGTLVTVSSGGGGSGGGGSGGGGSDIQMTQSPSSLSASVGDRVTITCRASQDISNYLNWYQQKSGKAPELLIYAASSLQSGVPSRFSGSGSGTDFTLTISSLQPEDFATYYCQQSYISPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 441 - protein, 5 aa, Artificial Sequence
  Synthetic peptide
SYAMS

SEQ ID NO: 442 - protein, 17 aa, Artificial Sequence
  Synthetic peptide
VISDSGGITDFADSVKG

SEQ ID NO: 443 - protein, 11 aa, Artificial Sequence
  Synthetic peptide
HDYSNYFFFDY

SEQ ID NO: 444 - protein, 11 aa, Artificial Sequence
  Synthetic peptide
RASQSISSYLN

SEQ ID NO: 445 - protein, 7 aa, Artificial Sequence
  Synthetic peptide
AASSLQS

SEQ ID NO: 446 - protein, 9 aa, Artificial Sequence
  Synthetic peptide
QQSYISPPT

SEQ ID NO: 447 - protein, 120 aa, Artificial Sequence
  Synthetic peptide
EVQLLESGGGVVQPGRSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSS

SEQ ID NO: 448 - protein, 107 aa, Artificial Sequence
  Synthetic peptide
DIQMTQSPSSLSASVGDRVTITCRASQSISSYLNWYQQKPGKAPKLLIYAASSLQSGVPSRFSGSGSGTDFTLTISSLQPEDFATYYCQQSYISPPTFGQGTKVEIK

SEQ ID NO: 449 - protein, 242 aa, Artificial Sequence
  Synthetic peptide
EVQLLESGGGVVQPGRSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYISPPTFGQGTKVEIK

SEQ ID NO: 450 - protein, 497 aa, Artificial Sequence
  Synthetic peptide
EVQLLESGGGVVQPGRSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYISPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 451 - protein, 5 aa, Artificial Sequence
  Synthetic peptide
SYAMS

SEQ ID NO: 452 - protein, 17 aa, Artificial Sequence
  Synthetic peptide
VISGSGGRTDYADSVKG

SEQ ID NO: 453 - protein, 11 aa, Artificial Sequence
  Synthetic peptide
HDYSNRFYFDY

SEQ ID NO: 454 - protein, 11 aa, Artificial Sequence
  Synthetic peptide
RASQSISSYLN

SEQ ID NO: 455 - protein, 7 aa, Artificial Sequence
  Synthetic peptide
AASSLQS

SEQ ID NO: 456 - protein, 9 aa, Artificial Sequence
  Synthetic peptide
QQSYSAPPT

SEQ ID NO: 457 - protein, 120 aa, Artificial Sequence
  Synthetic peptide
EVQLLESGGGLVQPGGSLRLSCAASGFTFSSYAMSWVRQVPGKGLEWVSVISGSGGRTDYADSVKGRFTISRDNSKNTLYLQMNSLRAEDTAVYYCARHDYSNRFYFDYWGQGTLVTVSS

SEQ ID NO: 458 - protein, 107 aa, Artificial Sequence
  Synthetic peptide
DIQMTQSPSSLSASVGDRVSITCRASQSISSYLNWYQQKPGKAPKLLIYAASSLQSGVPSRFSGSGSGTDFTLTISSLQPEDFATYYCQQSYSAPPTFGGGTKVEIK

SEQ ID NO: 459 - protein, 242 aa, Artificial Sequence
  Synthetic peptide
EVQLLESGGGLVQPGGSLRLSCAASGFTFSSYAMSWVRQVPGKGLEWVSVISGSGGRTDYADSVKGRFTISRDNSKNTLYLQMNSLRAEDTAVYYCARHDYSNRFYFDYWGQGTLVTVSSGGGGSGGGGSGGGGSDIQMTQSPSSLSASVGDRVSITCRASQSISSYLNWYQQKPGKAPKLLIYAASSLQSGVPSRFSGSGSGTDFTLTISSLQPEDFATYYCQQSYSAPPTFGGGTKVEIK

SEQ ID NO: 460 - protein, 497 aa, Artificial Sequence
  Synthetic peptide
EVQLLESGGGLVQPGGSLRLSCAASGFTFSSYAMSWVRQVPGKGLEWVSVISGSGGRTDYADSVKGRFTISRDNSKNTLYLQMNSLRAEDTAVYYCARHDYSNRFYFDYWGQGTLVTVSSGGGGSGGGGSGGGGSDIQMTQSPSSLSASVGDRVSITCRASQSISSYLNWYQQKPGKAPKLLIYAASSLQSGVPSRFSGSGSGTDFTLTISSLQPEDFATYYCQQSYSAPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 461 - protein, 5 aa, Artificial Sequence
  Synthetic peptide
SYAMS

SEQ ID NO: 462 - protein, 17 aa, Artificial Sequence
  Synthetic peptide
VISDSGGITDYADSVKG

SEQ ID NO: 463 - protein, 11 aa, Artificial Sequence
  Synthetic peptide
HDYSNRYYFDY

SEQ ID NO: 464 - protein, 11 aa, Artificial Sequence
  Synthetic peptide
RASQSISSYLN

SEQ ID NO: 465 - protein, 7 aa, Artificial Sequence
  Synthetic peptide
AASSLQS

SEQ ID NO: 466 - protein, 9 aa, Artificial Sequence
  Synthetic peptide
QQSYSTPLT

SEQ ID NO: 467 - protein, 120 aa, Artificial Sequence
  Synthetic peptide
EVQLLESGGGLVQPGGSLRLSCAASGFTFSSYAMSWVRQAPGKGLEWVSVISDSGGITDYADSVKGRFTISRDNSKNTLYLQMNSLRAEDRAVYYCARHDYSNRYYFDYWGQGTLVTVSS

SEQ ID NO: 468 - protein, 107 aa, Artificial Sequence [sequence omitted]

SEQ ID NO: 469 - protein, 242 aa, Artificial Sequence
  Synthetic peptide
EVQLLESGGGLVQPGGSLRLSCAASGFTFSSYAMSWVRQAPGKGLEWVSVISDSGGITDYADSVKGRFTISRDNSKNTLYLQMNSLRAEDRAVYYCARHDYSNRYYFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 470 - protein, 497 aa, Artificial Sequence
  Synthetic peptide
EVQLLESGGGLVQPGGSLRLSCAASGFTFSSYAMSWVRQAPGKGLEWVSVISDSGGITDYADSVKGRFTISRDNSKNTLYLQMNSLRAEDRAVYYCARHDYSNRYYFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 471 - protein, 5 aa, Artificial Sequence
  Synthetic peptide
SYAMS

SEQ ID NO: 472 - protein, 17 aa, Artificial Sequence
  Synthetic peptide
VISDSGGITDFADSVKG

SEQ ID NO: 473 - protein, 11 aa, Artificial Sequence
  Synthetic peptide
HDYSNYFFFDY

SEQ ID NO: 474 - protein, 11 aa, Artificial Sequence
  Synthetic peptide
RASQGISNYLA

SEQ ID NO: 475 - protein, 7 aa, Artificial Sequence
  Synthetic peptide
AASILQS

SEQ ID NO: 476 - protein, 9 aa, Artificial Sequence
  Synthetic peptide
QQYFAYPIT

SEQ ID NO: 477 - protein, 120 aa, Artificial Sequence
  Synthetic peptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSS

SEQ ID NO: 478 - protein, 107 aa, Artificial Sequence
  Synthetic peptide
DIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIK

SEQ ID NO: 479 - protein, 242 aa, Artificial Sequence
  Synthetic peptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIK

SEQ ID NO: 480 - protein, 497 aa, Artificial Sequence
  Synthetic peptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 481 - protein, 5 aa, Artificial Sequence
  Synthetic peptide
SYAMS

SEQ ID NO: 482 - protein, 17 aa, Artificial Sequence
  Synthetic peptide
VISDSGGITDFADSVKG

SEQ ID NO: 483 - protein, 11 aa, Artificial Sequence
  Synthetic peptide
HDYSNYFFFDY

SEQ ID NO: 484 - protein, 11 aa, Artificial Sequence
  Synthetic peptide
RASQSISSYLN

SEQ ID NO: 485 - protein, 7 aa, Artificial Sequence
  Synthetic peptide
AASSLQS

SEQ ID NO: 486 - protein, 9 aa, Artificial Sequence
  Synthetic peptide
QQSYSTPIT

SEQ ID NO: 487 - protein, 120 aa, Artificial Sequence
  Synthetic peptide
EVQLLESGGGLVQPGGSLRLSCAASGFTFSSYAMSWVRQAPGKGLEWVSVISDSGGITDFADSVKGRSTISRDNSRNTLYLQMNSLRAEDTAVYFCARHDYSNYFFFDYWGQGTLVTVSS

SEQ ID NO: 488 - protein, 107 aa, Artificial Sequence
  Synthetic peptide
DIQMTQSPSSVSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 489 - protein, 242 aa, Artificial Sequence
  Synthetic peptide
EVQLLESGGGLVQPGGSLRLSCAASGFTFSSYAMSWVRQAPGKGLEWVSVISDSGGITDFADSVKGRSTISRDNSRNTLYLQMNSLRAEDTAVYFCARHDYSNYFFFDYWGQGTLVTVSSGGGGSGGGGSGGGGSDIQMTQSPSSVSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 490 - protein, 497 aa, Artificial Sequence
  Synthetic peptide
EVQLLESGGGLVQPGGSLRLSCAASGFTFSSYAMSWVRQAPGKGLEWVSVISDSGGITDFADSVKGRSTISRDNSRNTLYLQMNSLRAEDTAVYFCARHDYSNYFFFDYWGQGTLVTVSSGGGGSGGGGSGGGGSDIQMTQSPSSVSASVGDRVTITCRASQSISSYLNWYQQKPGKAPKLLIYAASSLQSGVPSRFSGSGSGTDFTLTISSLQPEDFATYYCQQSYSTPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 491 - protein, 5 aa, Artificial Sequence
  Synthetic peptide
TYAMS

SEQ ID NO: 492 - protein, 17 aa, Artificial Sequence
  Synthetic peptide
AISGSGGYTYYADSVEG

SEQ ID NO: 493 - protein, 11 aa, Artificial Sequence
  Synthetic peptide
HDYSNYAWFDP

SEQ ID NO: 494 - protein, 11 aa, Artificial Sequence
  Synthetic peptide
RASQSISSYLN

SEQ ID NO: 495 - protein, 7 aa, Artificial Sequence
  Synthetic peptide
AASSLQS

SEQ ID NO: 496 - protein, 9 aa, Artificial Sequence
  Synthetic peptide
QQSYSTPFT

SEQ ID NO: 497 - protein, 120 aa, Artificial Sequence; identical to SEQ ID NO: 347
  Synthetic peptide

SEQ ID NO: 498 - protein, 107 aa, Artificial Sequence
  Synthetic peptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTRLEIK

SEQ ID NO: 499 - protein, 242 aa, Artificial Sequence
  Synthetic peptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTRLEIK

SEQ ID NO: 500 - protein, 497 aa, Artificial Sequence
  Synthetic peptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 501 - protein, 7 aa, Artificial Sequence
  Synthetic peptide
TDGYYWS

SEQ ID NO: 502 - protein, 16 aa, Artificial Sequence
  Synthetic peptide
YIYYSGSTNYNPSLKS

SEQ ID NO: 503 - protein, 8 aa, Artificial Sequence
  Synthetic peptide
GIGLGFEY

SEQ ID NO: 504 - protein, 11 aa, Artificial Sequence
  Synthetic peptide
GGNNIGSKSVH

SEQ ID NO: 505 - protein, 7 aa, Artificial Sequence
  Synthetic peptide
DDSDRPS

SEQ ID NO: 506 - protein, 12 aa, Artificial Sequence
  Synthetic peptide
QVWDRSSDQDVV

SEQ ID NO: 507 - protein, 118 aa, Artificial Sequence
  Synthetic peptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSS

SEQ ID NO: 508 - protein, 109 aa, Artificial Sequence
  Synthetic peptide
SYVLTQLTSVSVAPGQTARITCGGNNIGSKSVHWYQQKPGQAPVLVVYDDSDRPSGIPERFSGSNSGNTATLTISRVEAGDEADFYCQVWDRSSDQDVVFGGGTKLTVL

SEQ ID NO: 509 - protein, 242 aa, Artificial Sequence
  Synthetic peptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSSGGGGSGGGGSGGGGSSYVLTQLTSVSVAPGQTARITCGGNNIGSKSVHWYQQKPGQAPVLVVYDDSDRPSGIPERFSGSNSGNTATLTISRVEAGDEADFYCQVWDRSSDQDVVFGGGTKLTVL

SEQ ID NO: 510 - protein, 497 aa, Artificial Sequence
  Synthetic peptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSSGGGGSGGGGSGGGGSSYVLTQLTSVSVAPGQTARITCGGNNIGSKSVHWYQQKPGQAPVLVVYDDSDRPSGIPERFSGSNSGNTATLTISRVEAGDEADFYCQVWDRSSDQDVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 511 - protein, 7 aa, Artificial Sequence
  Synthetic peptide
TDGYYWS

SEQ ID NO: 512 - protein, 16 aa, Artificial Sequence
  Synthetic peptide
YIYYSGSTNYNPSLKS

SEQ ID NO: 513 - protein, 8 aa, Artificial Sequence
  Synthetic peptide
GIGLGFEY

SEQ ID NO: 514 - protein, 11 aa, Artificial Sequence
  Synthetic peptide
GGNNIGSKSVH

SEQ ID NO: 515 - protein, 7 aa, Artificial Sequence
  Synthetic peptide
DDSDRPS

SEQ ID NO: 516 - protein, 12 aa, Artificial Sequence
  Synthetic peptide
QVWDRSSDQDVV

SEQ ID NO: 517 - protein, 118 aa, Artificial Sequence; identical to SEQ ID NO: 507
  Synthetic peptide

SEQ ID NO: 518 - protein, 109 aa, Artificial Sequence
  Synthetic peptide
SYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGGGTKLTVL

SEQ ID NO: 519 - protein, 242 aa, Artificial Sequence
  Synthetic peptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSSGGGGSGGGGSGGGGSSYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGGGTKLTVL

SEQ ID NO: 520 - protein, 497 aa, Artificial Sequence
  Synthetic peptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSSGGGGSGGGGSGGGGSSYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 521 - protein, 5 aa, Artificial Sequence
  Synthetic peptide
SYAMS

SEQ ID NO: 522 - protein, 17 aa, Artificial Sequence
  Synthetic peptide
AISGSGGRTFYADSVEG

SEQ ID NO: 523 - protein, 11 aa, Artificial Sequence
  Synthetic peptide
HDYSNYPYFDY

SEQ ID NO: 524 - protein, 12 aa, Artificial Sequence
  Synthetic peptide
RASQSVRSSYLA

SEQ ID NO: 525 - protein, 7 aa, Artificial Sequence
  Synthetic peptide
GASSRAT

SEQ ID NO: 526 - protein, 9 aa, Artificial Sequence
  Synthetic peptide
QQYGSSPPT

SEQ ID NO: 527 - protein, 120 aa, Artificial Sequence; identical to SEQ ID NO: 157
  Synthetic peptide

SEQ ID NO: 528 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIK

SEQ ID NO: 529 - protein, 243 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIK

SEQ ID NO: 530 - protein, 498 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 531 - protein, 5 aa, Artificial Sequence
  Synthetic peptide
IYAMS

SEQ ID NO: 532 - protein, 17 aa, Artificial Sequence
  Synthetic peptide
AIGDSGGSTFYADSVKG

SEQ ID NO: 533 - protein, 11 aa, Artificial Sequence
  Synthetic peptide
HDYSNYPYFDY

SEQ ID NO: 534 - protein, 12 aa, Artificial Sequence
  Synthetic peptide
RASQSVRSSYVA

SEQ ID NO: 535 - protein, 7 aa, Artificial Sequence
  Synthetic peptide
GASSRAT

SEQ ID NO: 536 - protein, 9 aa, Artificial Sequence
  Synthetic peptide
QQYGDLPFT

SEQ ID NO: 537 - protein, 120 aa, Artificial Sequence
  Synthetic peptide
EVQLLESGGGLVQPGGSLRLSCAASGFTFSIYAMSWVRQAPGKGLEWVSAIGDSGGSTFYADSVKGRFTISRDNSKNTLYLQMNSLRAEDTAVYYCAKHDYSNYPYFDYWGQGTLVTVSS

SEQ ID NO: 538 - protein, 108 aa, Artificial Sequence
  Synthetic peptide
EIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIK

SEQ ID NO: 539 - protein, 243 aa, Artificial Sequence
  Synthetic peptide
EVQLLESGGGLVQPGGSLRLSCAASGFTFSIYAMSWVRQAPGKGLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIK

SEQ ID NO: 540 - protein, 498 aa, Artificial Sequence
  Synthetic peptide
EVQLLESGGGLVQPGGSLRLSCAASGFTFSIYAMSWVRQAPGKGLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 541 - protein, 5 aa, Artificial Sequence
  Synthetic peptide
SYGMH

SEQ ID NO: 542 - protein, 17 aa, Artificial Sequence
  Synthetic peptide
VISYDGSNKYYADSVKG

SEQ ID NO: 543 - protein, 15 aa, Artificial Sequence
  Synthetic peptide
GRYYGSGNYNHGMDV

SEQ ID NO: 544 - protein, 11 aa, Artificial Sequence
  Synthetic peptide
RASQSISSYLN

SEQ ID NO: 545 - protein, 7 aa, Artificial Sequence
  Synthetic peptide
AASSLQS

SEQ ID NO: 546 - protein, 9 aa, Artificial Sequence
  Synthetic peptide
QQSYSTPFT

SEQ ID NO: 547 - protein, 124 aa, Artificial Sequence
  Synthetic peptide
QVQLVESGGGVVQPGRSLRLSCAASGFMFSSYGMHWVRQAPGKGLEWVAVISYDGSNKYYADSVKGRFTISRDNSKNTLYLQMNSLRAEDTAVYYCARGRYYGSGNYNHGMDVWGQGTTVTVSS

SEQ ID NO: 548 - protein, 107 aa, Artificial Sequence
  Synthetic peptide
DIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIK

SEQ ID NO: 549 - protein, 246 aa, Artificial Sequence
  Synthetic peptide
QVQLVESGGGVVQPGRSLRLSCAASGFMFSSYGMHWVRQAPGKGLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIK

SEQ ID NO: 550 - protein, 501 aa, Artificial Sequence
  Synthetic peptide
QVQLVESGGGVVQPGRSLRLSCAASGFMFSSYGMHWVRQAPGKGLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 551 - protein, 5 aa, Artificial Sequence
  Synthetic peptide
SYGMH

SEQ ID NO: 552 - protein, 17 aa, Artificial Sequence
  Synthetic peptide
VISYDGSNKYYADSVKG

SEQ ID NO: 553 - protein, 15 aa, Artificial Sequence
  Synthetic peptide
GRYYGSGSYNYGMDV

SEQ ID NO: 554 - protein, 11 aa, Artificial Sequence
  Synthetic peptide
RASQSIFDYLN

SEQ ID NO: 555 - protein, 7 aa, Artificial Sequence
  Synthetic peptide
AASSLQS

SEQ ID NO: 556 - protein, 9 aa, Artificial Sequence
  Synthetic peptide
QQSYSTPLT

SEQ ID NO: 557 - protein, 124 aa, Artificial Sequence
  Synthetic peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYYGSGSYNYGMDVWGQGTTVTVSS

SEQ ID NO: 558 - protein, 107 aa, Artificial Sequence
  Synthetic peptide
DIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGGGTKLEIK

SEQ ID NO: 559 - protein, 246 aa, Artificial Sequence
  Synthetic peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYYGSGSYNYGMDVWGQGTTVTVSSGGGGSGGGGSGGGGSDIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGGGTKLEIK

SEQ ID NO: 560 - protein, 501 aa, Artificial Sequence
  Synthetic peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYYGSGSYNYGMDVWGQGTTVTVSSGGGGSGGGGSGGGGSDIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 561 - protein, 5 aa, Artificial Sequence
  Synthetic peptide
SYGMH

SEQ ID NO: 562 - protein, 17 aa, Artificial Sequence
  Synthetic peptide
VIWYDGSSEYYADSVKG

SEQ ID NO: 563 - protein, 11 aa, Artificial Sequence
  Synthetic peptide
DNSYNYYGMDV

SEQ ID NO: 564 - protein, 14 aa, Artificial Sequence
  Synthetic peptide
TGSSSNIGAAYDVH

SEQ ID NO: 565 - protein, 7 aa, Artificial Sequence
  Synthetic peptide
VNSHRPP

SEQ ID NO: 566 - protein, 11 aa, Artificial Sequence
  Synthetic peptide
LSYDNSLSGSV

SEQ ID NO: 567 - protein, 120 aa, Artificial Sequence
  Synthetic peptide
QVQLVESGGGVVQPGRSLRLSCAASGFTFSSYGMHWVRQAPGKGLEWVAVIWYDGSSEYYADSVKGRFTISRDNSKNTLYLQMNSLRAEDTAVYYCARDNSYNYYGMDVWGQGTTVTVSS

SEQ ID NO: 568 - protein, 111 aa, Artificial Sequence
  Synthetic peptide
QSVLTQPPSVSGAPGQRVTISCTGSSSNIGAAYDVHWYQQFPGTAPKLLIYVNSHRPPGVPDRFSGSKSGTSASLAITGLQAEDEADYYCLSYDNSLSGSVFGGGTKLTVL

SEQ ID NO: 569 - protein, 246 aa, Artificial Sequence
  Synthetic peptide
QVQLVESGGGVVQPGRSLRLSCAASGFTFSSYGMHWVRQAPGKGLEWVAVIWYDGSSEYYADSVKGRFTISRDNSKNTLYLQMNSLRAEDTAVYYCARDNSYNYYGMDVWGQGTTVTVSSGGGGSGGGGSGGGGSQSVLTQPPSVSGAPGQRVTISCTGSSSNIGAAYDVHWYQQFPGTAPKLLIYVNSHRPPGVPDRFSGSKSGTSASLAITGLQAEDEADYYCLSYDNSLSGSVFGGGTKLTVL

SEQ ID NO: 570 - protein, 501 aa, Artificial Sequence
  Synthetic peptide
QVQLVESGGGVVQPGRSLRLSCAASGFTFSSYGMHWVRQAPGKGLEWVAVIWYDGSSEYYADSVKGRFTISRDNSKNTLYLQMNSLRAEDTAVYYCARDNSYNYYGMDVWGQGTTVTVSSGGGGSGGGGSGGGGSQSVLTQPPSVSGAPGQRVTISCTGSSSNIGAAYDVHWYQQFPGTAPKLLIYVNSHRPPGVPDRFSGSKSGTSASLAITGLQAEDEADYYCLSYDNSLSGSVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 571 - protein, 7 aa, Artificial Sequence
  Synthetic peptide
SSSYYWG

SEQ ID NO: 572 - protein, 16 aa, Artificial Sequence
  Synthetic peptide
SIYHSGGTYFNPSLKS

SEQ ID NO: 573 - protein, 15 aa, Artificial Sequence
  Synthetic peptide
HYEILTGYYPDVFDI

SEQ ID NO: 574 - protein, 11 aa, Artificial Sequence
  Synthetic peptide
RASQSISSYLN

SEQ ID NO: 575 - protein, 7 aa, Artificial Sequence
  Synthetic peptide
AASNLQS

SEQ ID NO: 576 - protein, 9 aa, Artificial Sequence
  Synthetic peptide
QQSFSSPRT

SEQ ID NO: 577 - protein, 125 aa, Artificial Sequence
  Synthetic peptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSS

SEQ ID NO: 578 - protein, 107 aa, Artificial Sequence
  Synthetic peptide
DIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIK

SEQ ID NO: 579 - protein, 247 aa, Artificial Sequence
  Synthetic peptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIK

SEQ ID NO: 580 - protein, 502 aa, Artificial Sequence [sequence omitted]

SEQ ID NO: 581 - protein, 5 aa, Artificial Sequence
  Synthetic peptide
GFYWS

SEQ ID NO: 582 - protein, 16 aa, Artificial Sequence
  Synthetic peptide
EIDHSGSTNYNPSLKS

SEQ ID NO: 583 - protein, 10 aa, Artificial Sequence
  Synthetic peptide
NGYSGYLFDY

SEQ ID NO: 584 - protein, 11 aa, Artificial Sequence
  Synthetic peptide
RASQIISSYLN

SEQ ID NO: 585 - protein, 7 aa, Artificial Sequence
  Synthetic peptide
GASSMQS

SEQ ID NO: 586 - protein, 9 aa, Artificial Sequence
  Synthetic peptide
QQSYSIPRT

SEQ ID NO: 587 - protein, 118 aa, Artificial Sequence
  Synthetic peptide
QVQLQQWGAGLLKPSETLSLTCAVYDGSVSGFYWSWIRQPPGKGLEWIGEIDHSGSTNYNPSLKSRVTISVDTSKNQFSLKLSSVTAADSAVYYCARNGYSGYLFDYWGQGTLVTVSS

SEQ ID NO: 588 - protein, 107 aa, Artificial Sequence
  Synthetic peptide
DIQMTQSPSSLSASVGDRVTITCRASQIISSYLNWYQQKPGKAPKVLIYGASSMQSGVPSRFSGSGYGTDFTLTISSLQPEDFATYYCQQSYSIPRTFGQGTKLEIK

SEQ ID NO: 589 - protein, 240 aa, Artificial Sequence
  Synthetic peptide
QVQLQQWGAGLLKPSETLSLTCAVYDGSVSGFYWSWIRQPPGKGLEWIGEIDHSGSTNYNPSLKSRVTISVDTSKNQFSLKLSSVTAADSAVYYCARNGYSGYLFDYWGQGTLVTVSSGGGGSGGGGSGGGGSDIQMTQSPSSLSASVGDRVTITCRASQIISSYLNWYQQKPGKAPKVLIYGASSMQSGVPSRFSGSGYGTDFTLTISSLQPEDFATYYCQQSYSIPRTFGQGTKLEIK

SEQ ID NO: 590 - protein, 495 aa, Artificial Sequence
  Synthetic peptide
QVQLQQWGAGLLKPSETLSLTCAVYDGSVSGFYWSWIRQPPGKGLEWIGEIDHSGSTNYNPSLKSRVTISVDTSKNQFSLKLSSVTAADSAVYYCARNGYSGYLFDYWGQGTLVTVSSGGGGSGGGGSGGGGSDIQMTQSPSSLSASVGDRVTITCRASQIISSYLNWYQQKPGKAPKVLIYGASSMQSGVPSRFSGSGYGTDFTLTISSLQPEDFATYYCQQSYSIPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 591 - protein, 5 aa, Artificial Sequence
  Synthetic peptide
TYYWS

SEQ ID NO: 592 - protein, 16 aa, Artificial Sequence
  Synthetic peptide
RIYPTGITNYNPSLKS

SEQ ID NO: 593 - protein, 17 aa, Artificial Sequence
  Synthetic peptide
DRRFLEPSYYYYYGMDV

SEQ ID NO: 594 - protein, 16 aa, Artificial Sequence
  Synthetic peptide
RSSQSLLHSNGYNYLD

SEQ ID NO: 595 - protein, 7 aa, Artificial Sequence
  Synthetic peptide
LGSNRAS

SEQ ID NO: 596 - protein, 9 aa, Artificial Sequence
  Synthetic peptide
MQGLRTPFT

SEQ ID NO: 597 - protein, 125 aa, Artificial Sequence
  Synthetic peptide
QVQLQESGPGLVKPSETLSLTCTVSGDSISTYYWSWIRQPAGKGLEWIGRIYPTGITNYNPSLKSRVTISVDTSKNQFSLKLSSVTAADTAVYYCARDRRFLEPSYYYYYGMDVWGQGTTVTVSS

SEQ ID NO: 598 - protein, 112 aa, Artificial Sequence
  Synthetic peptide
DIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGPGTKLEIK

SEQ ID NO: 599 - protein, 252 aa, Artificial Sequence
  Synthetic peptide
QVQLQESGPGLVKPSETLSLTCTVSGDSISTYYWSWIRQPAGKGLEWIGRIYPTGITNYNPSLKSRVTISVDTSKNQFSLKLSSVTAADTAVYYCARDRRFLEPSYYYYYGMDVWGQGTTVTVSSGGGGSGGGGSGGGGSDIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGPGTKLEIK

SEQ ID NO: 600 - protein, 507 aa, Artificial Sequence
  Synthetic peptide
QVQLQESGPGLVKPSETLSLTCTVSGDSISTYYWSWIRQPAGKGLEWIGRIYPTGITNYNPSLKSRVTISVDTSKNQFSLKLSSVTAADTAVYYCARDRRFLEPSYYYYYGMDVWGQGTTVTVSSGGGGSGGGGSGGGGSDIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 601 - protein, 5 aa, Artificial Sequence
  Synthetic peptide
SYAMS

SEQ ID NO: 602 - protein, 17 aa, Artificial Sequence
  Synthetic peptide
VISDSGGITDFADSVKG

SEQ ID NO: 603 - protein, 11 aa, Artificial Sequence
  Synthetic peptide
HDYSNYFFFDY

SEQ ID NO: 604 - protein, 11 aa, Artificial Sequence
  Synthetic peptide
RASQSISNYLN

SEQ ID NO: 605 - protein, 7 aa, Artificial Sequence
  Synthetic peptide
AASSLQS

SEQ ID NO: 606 - protein, 9 aa, Artificial Sequence
  Synthetic peptide
QQSYIIPPT

SEQ ID NO: 607 - protein, 120 aa, Artificial Sequence; identical to SEQ ID NO: 477
  Synthetic peptide

SEQ ID NO: 608 - protein, 107 aa, Artificial Sequence
  Synthetic peptide
DIQMTQSPSSLSASVGDRITITCRASQSISNYLNWYQQKPGKAPKLLISAASSLQSGVPSRFSGSGSGTDFTLTISSLQPEDFATYYCQQSYIIPPTFGQGTKVDIK

SEQ ID NO: 609 - protein, 242 aa, Artificial Sequence
  Synthetic peptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRITITCRASQSISNYLNWYQQKPGKAPKLLISAASSLQSGVPSRFSGSGSGTDFTLTISSLQPEDFATYYCQQSYIIPPTFGQGTKVDIK

SEQ ID NO: 610 - protein, 497 aa, Artificial Sequence
  Synthetic peptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRITITCRASQSISNYLNWYQQKPGKAPKLLISAASSLQSGVPSRFSGSGSGTDFTLTISSLQPEDFATYYCQQSYIIPPTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 611 - protein, 5 aa, Artificial Sequence
  Synthetic peptide
SYSMN

SEQ ID NO: 612 - protein, 17 aa, Artificial Sequence
  Synthetic peptide
YISSSGGYIYYADSVKG

SEQ ID NO: 613 - protein, 11 aa, Artificial Sequence
  Synthetic peptide
GDYSNYAYFDY

SEQ ID NO: 614 - protein, 11 aa, Artificial Sequence
  Synthetic peptide
RASQGISNYLA

SEQ ID NO: 615 - protein, 7 aa, Artificial Sequence
  Synthetic peptide
AASTLQS

SEQ ID NO: 616 - protein, 9 aa, Artificial Sequence
  Synthetic peptide
QQYYSTPLT

SEQ ID NO: 617 - protein, 120 aa, Artificial Sequence
  Synthetic peptide
EVQLVESGGGLVKPGGSLRLSCAASGFTFSSYSMNWVRQAPGKGLEWVSYISSSGGYIYYADSVKGRFTISRDNAKNSLYLQMNSLRAEDAAVYYCSRGDYSNYAYFDYWGQGTLVTVSS

SEQ ID NO: 618 - protein, 107 aa, Artificial Sequence
  Synthetic peptide
DIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIK

SEQ ID NO: 619 - protein, 242 aa, Artificial Sequence
  Synthetic peptide
EVQLVESGGGLVKPGGSLRLSCAASGFTFSSYSMNWVRQAPGKGLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIK

SEQ ID NO: 620 - protein, 497 aa, Artificial Sequence
  Synthetic peptide
EVQLVESGGGLVKPGGSLRLSCAASGFTFSSYSMNWVRQAPGKGLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 621 - protein, 5 aa, Artificial Sequence
  Synthetic peptide
TYTMN

SEQ ID NO: 622 - protein, 17 aa, Artificial Sequence
  Synthetic peptide
SISSSSGYIYYADSVKG

SEQ ID NO: 623 - protein, 11 aa, Artificial Sequence
  Synthetic peptide
GDYSNYLYFDL

SEQ ID NO: 624 - protein, 12 aa, Artificial Sequence
  Synthetic peptide
RASQSFRSSYLA

SEQ ID NO: 625 - protein, 7 aa, Artificial Sequence
  Synthetic peptide
GASSRAT

SEQ ID NO: 626 - protein, 9 aa, Artificial Sequence
  Synthetic peptide
QLYGSLPIT

SEQ ID NO: 627 - protein, 120 aa, Artificial Sequence
  Synthetic peptide
EVQLVESGGGLVKPGGSLRLSCAASGITFSTYTMNWVRQAPGKGLEWVSSISSSSGYIYYADSVKGRFTISRDNAKNSLYLQMNSLRAEDTAVYYCARGDYSNYLYFDLWGRGTLVTVSS

SEQ ID NO: 628 - protein, 108 aa, Artificial Sequence
  Synthetic peptide
EIVLTQSPGTLSLSPGERATLSCRASQSFRSSYLAWYQQKPGQAPRLLIHGASSRATGIPDRFSGSGSGTDFTLTISRLEPEDFAVYYCQLYGSLPITFGQGTRLEIK

SEQ ID NO: 629 - protein, 243 aa, Artificial Sequence
  Synthetic peptide
EVQLVESGGGLVKPGGSLRLSCAASGITFSTYTMNWVRQAPGKGLEWVSSISSSSGYIYYADSVKGRFTISRDNAKNSLYLQMNSLRAEDTAVYYCARGDYSNYLYFDLWGRGTLVTVSSGGGGSGGGGSGGGGSEIVLTQSPGTLSLSPGERATLSCRASQSFRSSYLAWYQQKPGQAPRLLIHGASSRATGIPDRFSGSGSGTDFTLTISRLEPEDFAVYYCQLYGSLPITFGQGTRLEIK

SEQ ID NO: 630 - protein, 498 aa, Artificial Sequence
  Synthetic peptide
EVQLVESGGGLVKPGGSLRLSCAASGITFSTYTMNWVRQAPGKGLEWVSSISSSSGYIYYADSVKGRFTISRDNAKNSLYLQMNSLRAEDTAVYYCARGDYSNYLYFDLWGRGTLVTVSSGGGGSGGGGSGGGGSEIVLTQSPGTLSLSPGERATLSCRASQSFRSSYLAWYQQKPGQAPRLLIHGASSRATGIPDRFSGSGSGTDFTLTISRLEPEDFAVYYCQLYGSLPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 631 - protein, 5 aa, Artificial Sequence
  Synthetic peptide
VYAMS

SEQ ID NO: 632 - protein, 17 aa, Artificial Sequence
  Synthetic peptide
TISDSGGSTFYADSVKG

SEQ ID NO: 633 - protein, 11 aa, Artificial Sequence
  Synthetic peptide
HDYSNYAYFDY

SEQ ID NO: 634 - protein, 12 aa, Artificial Sequence
  Synthetic peptide
RASQSVRSSYLA

SEQ ID NO: 635 - protein, 7 aa, Artificial Sequence
  Synthetic peptide
GASSRAT

SEQ ID NO: 636 - protein, 9 aa, Artificial Sequence
  Synthetic peptide
QQYGDLPFT

SEQ ID NO: 637 - protein, 120 aa, Artificial Sequence
  Synthetic peptide
EVQLLESGGGLVQPGGSLRLSCAASGFTFSVYAMSWVRQAPGKCLEWVSTISDSGGSTFYADSVKGRFTISRDNSKNTLYLQMNRLRAEDTAVYYCARHDYSNYAYFDYWGQGTLVTVSS

SEQ ID NO: 638 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 639 - protein, 243 aa, Artificial Sequence
  Synthetic peptide
EVQLLESGGGLVQPGGSLRLSCAASGFTFSVYAMSWVRQAPGKCLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 640 - protein, 498 aa, Artificial Sequence
  Synthetic peptide
EVQLLESGGGLVQPGGSLRLSCAASGFTFSVYAMSWVRQAPGKCLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 641 - protein, 5 aa, Artificial Sequence
  Synthetic peptide
TYAMS

SEQ ID NO: 642 - protein, 17 aa, Artificial Sequence
  Synthetic peptide
AISGSGGYTYYADSVEG

SEQ ID NO: 643 - protein, 11 aa, Artificial Sequence
  Synthetic peptide
HDYSNYAWFDP

SEQ ID NO: 644 - protein, 12 aa, Artificial Sequence
  Synthetic peptide
RASQSVSSAYLA

SEQ ID NO: 645 - protein, 7 aa, Artificial Sequence
  Synthetic peptide
GASSRAT

SEQ ID NO: 646 - protein, 9 aa, Artificial Sequence
  Synthetic peptide
QQFGSSPFT

SEQ ID NO: 647 - protein, 120 aa, Artificial Sequence
  Synthetic peptide
EVQLLESGGGLVQPGGSLRLSCAASGFTFSTYAMSWVRQAPGKCLDWVSAISGSGGYTYYADSVEGRFTISRDNSRNTLYLQMNSLRAEDTAVYYCASHDYSNYAWFDPWGQGTLVTVSS

SEQ ID NO: 648 - protein, 108 aa, Artificial Sequence
  Synthetic peptide
EIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGCGTKVEIK

SEQ ID NO: 649 - protein, 243 aa, Artificial Sequence
  Synthetic peptide
EVQLLESGGGLVQPGGSLRLSCAASGFTFSTYAMSWVRQAPGKCLDWVSAISGSGGYTYYADSVEGRFTISRDNSRNTLYLQMNSLRAEDTAVYYCASHDYSNYAWFDPWGQGTLVTVSSGGGGSGGGGSGGGGSEIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGCGTKVEIK

SEQ ID NO: 650 - protein, 498 aa, Artificial Sequence
  Synthetic peptide
EVQLLESGGGLVQPGGSLRLSCAASGFTFSTYAMSWVRQAPGKCLDWVSAISGSGGYTYYADSVEGRFTISRDNSRNTLYLQMNSLRAEDTAVYYCASHDYSNYAWFDPWGQGTLVTVSSGGGGSGGGGSGGGGSEIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 651 - protein, 5 aa, Artificial Sequence
  Synthetic peptide
SYAMS

SEQ ID NO: 652 - protein, 17 aa, Artificial Sequence
  Synthetic peptide
AISGSGGRTYYADSVKG

SEQ ID NO: 653 - protein, 11 aa, Artificial Sequence
  Synthetic peptide
HDYSNYPYFDY

SEQ ID NO: 654 - protein, 12 aa, Artificial Sequence
  Synthetic peptide
RASQSVRGSYLA

SEQ ID NO: 655 - protein, 7 aa, Artificial Sequence
  Synthetic peptide
SASSRAT

SEQ ID NO: 656 - protein, 9 aa, Artificial Sequence
  Synthetic peptide
QQYGDSPFT

SEQ ID NO: 657 - protein, 120 aa, Artificial Sequence
  Synthetic peptide
EVQLLESGGGLVQPGGSLRLSCAASGFTFSSYAMSWVRQAPGQCLEWVSAISGSGGRTYYADSVKGRFTISRDNSKNTLYLQMNSLRAEDTAVYYCAKHDYSNYPYFDYWGQGTLVTVSS

SEQ ID NO: 658 - protein, 108 aa, Artificial Sequence
  Synthetic peptide
EIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGCGTKVEIK

SEQ ID NO: 659 - protein, 243 aa, Artificial Sequence
  Synthetic peptide
EVQLLESGGGLVQPGGSLRLSCAASGFTFSSYAMSWVRQAPGQCLEWVSAISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGCGTKVEIK

SEQ ID NO: 660 - protein, 498 aa, Artificial Sequence
  Synthetic peptide
EVQLLESGGGLVQPGGSLRLSCAASGFTFSSYAMSWVRQAPGQCLEWVSAISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 661 - protein, 5 aa, Artificial Sequence
  Synthetic peptide
SYAMS

SEQ ID NO: 662 - protein, 17 aa, Artificial Sequence
  Synthetic peptide
VISDSGGITDFADSVKG

SEQ ID NO: 663 - protein, 11 aa, Artificial Sequence
  Synthetic peptide
HDYSNYFFFDY

SEQ ID NO: 664 - protein, 11 aa, Artificial Sequence
  Synthetic peptide
RASQDISNYLN

SEQ ID NO: 665 - protein, 7 aa, Artificial Sequence
  Synthetic peptide
AASSLQS

SEQ ID NO: 666 - protein, 9 aa, Artificial Sequence
  Synthetic peptide
QQSYISPPT

SEQ ID NO: 667 - protein, 120 aa, Artificial Sequence
  Synthetic peptide
EVQLLESGGGLVQPGGSLRLSCAASGFTFSSYAMSWVRQAPGKCLEWVSVISDSGGITDFADSVKGRFIISRDNSRNTLYLQMNSLRAEDTAVYFCARHDYSNYFFFDYWGQGTLVTVSS

SEQ ID NO: 668 - protein, 107 aa, Artificial Sequence
  Synthetic peptide
DIQMTQSPSSLSASVGDRVTITCRASQDISNYLNWYQQKSGKAPELLIYAASSLQSGVPSRFSGSGSGTDFTLTISSLQPEDFATYYCQQSYISPPTFGCGTKVEIK

SEQ ID NO: 669 - protein, 242 aa, Artificial Sequence
  Synthetic peptide
EVQLLESGGGLVQPGGSLRLSCAASGFTFSSYAMSWVRQAPGKCLEWVSVISDSGGITDFADSVKGRFIISRDNSRNTLYLQMNSLRAEDTAVYFCARHDYSNYFFFDYWGQGTLVTVSSGGGGSGGGGSGGGGSDIQMTQSPSSLSASVGDRVTITCRASQDISNYLNWYQQKSGKAPELLIYAASSLQSGVPSRFSGSGSGTDFTLTISSLQPEDFATYYCQQSYISPPTFGCGTKVEIK

SEQ ID NO: 670 - protein, 497 aa, Artificial Sequence
  Synthetic peptide
EVQLLESGGGLVQPGGSLRLSCAASGFTFSSYAMSWVRQAPGKCLEWVSVISDSGGITDFADSVKGRFIISRDNSRNTLYLQMNSLRAEDTAVYFCARHDYSNYFFFDYWGQGTLVTVSSGGGGSGGGGSGGGGSDIQMTQSPSSLSASVGDRVTITCRASQDISNYLNWYQQKSGKAPELLIYAASSLQSGVPSRFSGSGSGTDFTLTISSLQPEDFATYYCQQSYISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 671 - protein, 5 aa, Artificial Sequence
  Synthetic peptide
SYAMS

SEQ ID NO: 672 - protein, 17 aa, Artificial Sequence
  Synthetic peptide
VISDSGGITDFADSVKG

SEQ ID NO: 673 - protein, 11 aa, Artificial Sequence
  Synthetic peptide
HDYSNYFFFDY

SEQ ID NO: 674 - protein, 11 aa, Artificial Sequence
  Synthetic peptide
RASQGISNYLA

SEQ ID NO: 675 - protein, 7 aa, Artificial Sequence
  Synthetic peptide
AASILQS

SEQ ID NO: 676 - protein, 9 aa, Artificial Sequence
  Synthetic peptide
QQYFAYPIT

SEQ ID NO: 677 - protein, 120 aa, Artificial Sequence
  Synthetic peptide
EVQLLESGGGLVQPGGSLRLSCAASGFTFSSYAMSWVRQAPGKCLEWVSVISDSGGITDFADSVKGRFTISRDNSRNTLYLQMNSLRAEDTAVYFCARHDYSNYFFFDYWGQGTLVTVSS

SEQ ID NO: 678 - protein, 107 aa, Artificial Sequence
  Synthetic peptide
DIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIK

SEQ ID NO: 679 - protein, 242 aa, Artificial Sequence
  Synthetic peptide
EVQLLESGGGLVQPGGSLRLSCAASGFTFSSYAMSWVRQAPGKCLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIK

SEQ ID NO: 680 - protein, 497 aa, Artificial Sequence
  Synthetic peptide
EVQLLESGGGLVQPGGSLRLSCAASGFTFSSYAMSWVRQAPGKCLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 681 - protein, 7 aa, Artificial Sequence
  Synthetic peptide
TDGYYWS

SEQ ID NO: 682 - protein, 16 aa, Artificial Sequence
  Synthetic peptide
YIYYSGSTNYNPSLKS

SEQ ID NO: 683 - protein, 8 aa, Artificial Sequence
  Synthetic peptide
GIGLGFEY

SEQ ID NO: 684 - protein, 11 aa, Artificial Sequence
  Synthetic peptide
GGNNIGSKSVH

SEQ ID NO: 685 - protein, 7 aa, Artificial Sequence
  Synthetic peptide
DDSDRPS

SEQ ID NO: 686 - protein, 12 aa, Artificial Sequence
  Synthetic peptide
QVWDRSSDQDVV

SEQ ID NO: 687 - protein, 118 aa, Artificial Sequence
  Synthetic peptide
QVQLQESGPGLVKPSETLSLTCTVSGGSVSTDGYYWSWIRQPPGKCLEWIGYIYYSGSTNYNPSLKSRVTISVDTSKNQFSLKLISVTAADTAVYYCARGIGLGFEYWGQGTLVTVSS

SEQ ID NO: 688 - protein, 109 aa, Artificial Sequence
  Synthetic peptide
SYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGCGTKLTVL

SEQ ID NO: 689 - protein, 242 aa, Artificial Sequence
  Synthetic peptide
QVQLQESGPGLVKPSETLSLTCTVSGGSVSTDGYYWSWIRQPPGKCLEWIGYIYYSGSTNYNPSLKSRVTISVDTSKNQFSLKLISVTAADTAVYYCARGIGLGFEYWGQGTLVTVSSGGGGSGGGGSGGGGSSYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGCGTKLTVL

SEQ ID NO: 690 - protein, 497 aa, Artificial Sequence
  Synthetic peptide
QVQLQESGPGLVKPSETLSLTCTVSGGSVSTDGYYWSWIRQPPGKCLEWIGYIYYSGSTNYNPSLKSRVTISVDTSKNQFSLKLISVTAADTAVYYCARGIGLGFEYWGQGTLVTVSSGGGGSGGGGSGGGGSSYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 691 - protein, 5 aa, Artificial Sequence
  Synthetic peptide
SYGMH

SEQ ID NO: 692 - protein, 17 aa, Artificial Sequence
  Synthetic peptide
VISYDGSNKYYADSVKG

SEQ ID NO: 693 - protein, 15 aa, Artificial Sequence
  Synthetic peptide
GRYYGSGNYNHGMDV

SEQ ID NO: 694 - protein, 11 aa, Artificial Sequence
  Synthetic peptide
RASQSISSYLN

SEQ ID NO: 695 - protein, 7 aa, Artificial Sequence
  Synthetic peptide
AASSLQS

SEQ ID NO: 696 - protein, 9 aa, Artificial Sequence
  Synthetic peptide
QQSYSTPFT

SEQ ID NO: 697 - protein, 124 aa, Artificial Sequence
  Synthetic peptide
QVQLVESGGGVVQPGRSLRLSCAASGFMFSSYGMHWVRQAPGKCLEWVAVISYDGSNKYYADSVKGRFTISRDNSKNTLYLQMNSLRAEDTAVYYCARGRYYGSGNYNHGMDVWGQGTTVTVSS

SEQ ID NO: 698 - protein, 107 aa, Artificial Sequence
  Synthetic peptide
DIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIK

SEQ ID NO: 699 - protein, 246 aa, Artificial Sequence
  Synthetic peptide
QVQLVESGGGVVQPGRSLRLSCAASGFMFSSYGMHWVRQAPGKCLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIK

SEQ ID NO: 700 - protein, 501 aa, Artificial Sequence
  Synthetic peptide
QVQLVESGGGVVQPGRSLRLSCAASGFMFSSYGMHWVRQAPGKCLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 701 - protein, 5 aa, Artificial Sequence
  Synthetic peptide
SYGMH

SEQ ID NO: 702 - protein, 17 aa, Artificial Sequence
  Synthetic peptide
VISYDGSNKYYADSVKG

SEQ ID NO: 703 - protein, 15 aa, Artificial Sequence
  Synthetic peptide
GRYYGSGSYNYGMDV

SEQ ID NO: 704 - protein, 11 aa, Artificial Sequence
  Synthetic peptide
RASQSIFDYLN

SEQ ID NO: 705 - protein, 7 aa, Artificial Sequence
  Synthetic peptide
AASSLQS

SEQ ID NO: 706 - protein, 9 aa, Artificial Sequence
  Synthetic peptide
QQSYSTPLT

SEQ ID NO: 707 - protein, 124 aa, Artificial Sequence
  Synthetic peptide
QVQLVESGGGVVQPGRSLRLSCAASGFTFSSYGMHWVRQAPGKCLEWVAVISYDGSNKYYADSVKGRFTISRDNSKNTLYLQMNSLRAEDTAVYYCARGRYYGSGSYNYGMDVWGQGTTVTVSS

SEQ ID NO: 708 - protein, 107 aa, Artificial Sequence
  Synthetic peptide
DIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGCGTKLEIK

SEQ ID NO: 709 - protein, 246 aa, Artificial Sequence
  Synthetic peptide
QVQLVESGGGVVQPGRSLRLSCAASGFTFSSYGMHWVRQAPGKCLEWVAVISYDGSNKYYADSVKGRFTISRDNSKNTLYLQMNSLRAEDTAVYYCARGRYYGSGSYNYGMDVWGQGTTVTVSSGGGGSGGGGSGGGGSDIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGCGTKLEIK

SEQ ID NO: 710 - protein, 501 aa, Artificial Sequence
  Synthetic peptide
QVQLVESGGGVVQPGRSLRLSCAASGFTFSSYGMHWVRQAPGKCLEWVAVISYDGSNKYYADSVKGRFTISRDNSKNTLYLQMNSLRAEDTAVYYCARGRYYGSGSYNYGMDVWGQGTTVTVSSGGGGSGGGGSGGGGSDIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 711 - protein, 5 aa, Artificial Sequence
  Synthetic peptide
TYYWS

SEQ ID NO: 712 - protein, 16 aa, Artificial Sequence
  Synthetic peptide
RIYPTGITNYNPSLKS

SEQ ID NO: 713 - protein, 17 aa, Artificial Sequence
  Synthetic peptide
DRRFLEPSYYYYYGMDV

SEQ ID NO: 714 - protein, 16 aa, Artificial Sequence
  Synthetic peptide
RSSQSLLHSNGYNYLD

SEQ ID NO: 715 - protein, 7 aa, Artificial Sequence
  Synthetic peptide
LGSNRAS

SEQ ID NO: 716 - protein, 9 aa, Artificial Sequence
  Synthetic peptide
MQGLRTPFT

SEQ ID NO: 717 - protein, 125 aa, Artificial Sequence
  Synthetic peptide
QVQLQESGPGLVKPSETLSLTCTVSGDSISTYYWSWIRQPAGKCLEWIGRIYPTGITNYNPSLKSRVTISVDTSKNQFSLKLSSVTAADTAVYYCARDRRFLEPSYYYYYGMDVWGQGTTVTVSS

SEQ ID NO: 718 - protein, 112 aa, Artificial Sequence
  Synthetic peptide
DIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGCGTKLEIK

SEQ ID NO: 719 - protein, 252 aa, Artificial Sequence
  Synthetic peptide
QVQLQESGPGLVKPSETLSLTCTVSGDSISTYYWSWIRQPAGKCLEWIGRIYPTGITNYNPSLKSRVTISVDTSKNQFSLKLSSVTAADTAVYYCARDRRFLEPSYYYYYGMDVWGQGTTVTVSSGGGGSGGGGSGGGGSDIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGCGTKLEIK

SEQ ID NO: 720 - protein, 507 aa, Artificial Sequence
  Synthetic peptide
QVQLQESGPGLVKPSETLSLTCTVSGDSISTYYWSWIRQPAGKCLEWIGRIYPTGITNYNPSLKSRVTISVDTSKNQFSLKLSSVTAADTAVYYCARDRRFLEPSYYYYYGMDVWGQGTTVTVSSGGGGSGGGGSGGGGSDIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 721 - protein, 5 aa, Artificial Sequence
  Synthetic peptide
SYSMN

SEQ ID NO: 722 - protein, 17 aa, Artificial Sequence
  Synthetic peptide
YISSSGGYIYYADSVKG

SEQ ID NO: 723 - protein, 11 aa, Artificial Sequence
  Synthetic peptide
GDYSNYAYFDY

SEQ ID NO: 724 - protein, 11 aa, Artificial Sequence
  Synthetic peptide
RASQGISNYLA

SEQ ID NO: 725 - protein, 7 aa, Artificial Sequence
  Synthetic peptide
AASTLQS

SEQ ID NO: 726 - protein, 9 aa, Artificial Sequence
  Synthetic peptide
QQYYSTPLT

SEQ ID NO: 727 - protein, 120 aa, Artificial Sequence
  Synthetic peptide
EVQLVESGGGLVKPGGSLRLSCAASGFTFSSYSMNWVRQAPGKCLEWVSYISSSGGYIYYADSVKGRFTISRDNAKNSLYLQMNSLRAEDAAVYYCSRGDYSNYAYFDYWGQGTLVTVSS

SEQ ID NO: 728 - protein, 107 aa, Artificial Sequence
  Synthetic peptide
DIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIK

SEQ ID NO: 729 - protein, 242 aa, Artificial Sequence
  Synthetic peptide
EVQLVESGGGLVKPGGSLRLSCAASGFTFSSYSMNWVRQAPGKCLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIK

SEQ ID NO: 730 - protein, 497 aa, Artificial Sequence
  Synthetic peptide
EVQLVESGGGLVKPGGSLRLSCAASGFTFSSYSMNWVRQAPGKCLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 731 - protein, 5 aa, Artificial Sequence
  Synthetic peptide
SYAMS

SEQ ID NO: 732 - protein, 17 aa, Artificial Sequence
  Synthetic peptide
AISGSGGSTFYADSVQG

SEQ ID NO: 733 - protein, 11 aa, Artificial Sequence
  Synthetic peptide
HDYSNYPYFDY

SEQ ID NO: 734 - protein, 12 aa, Artificial Sequence
  Synthetic peptide
RASQSVRGNYLA

SEQ ID NO: 735 - protein, 7 aa, Artificial Sequence
  Synthetic peptide
GASSRAT

SEQ ID NO: 736 - protein, 9 aa, Artificial Sequence
  Synthetic peptide
QQYGYSPFT

SEQ ID NO: 737 - protein, 120 aa, Artificial Sequence
  Synthetic peptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSS

SEQ ID NO: 738 - protein, 108 aa, Artificial Sequence
  Synthetic peptide
EIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVDIK

SEQ ID NO: 739 - protein, 243 aa, Artificial Sequence
  Synthetic peptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVDIK

SEQ ID NO: 740 - protein, 498 aa, Artificial Sequence
  Synthetic peptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 741 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 742 - protein, 151 aa, Homo sapiens
QAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 743 - protein, 20 aa, Homo sapiens
QAQQQLPLESLGWDVAELQL

SEQ ID NO: 744 - protein, 22 aa, Homo sapiens
NHTGPQQDPRLYWQGGPALGRS

SEQ ID NO: 745 - protein, 25 aa, Homo sapiens
FLHGPELDKGQLRIHRDGIYMVHIQ

SEQ ID NO: 746 - protein, 25 aa, Homo sapiens
VTLAICSSTTASRHHPTTLAVGICS

SEQ ID NO: 747 - protein, 17 aa, Homo sapiens
PASRSISLLRLSFHQGC

SEQ ID NO: 748 - protein, 24 aa, Homo sapiens
TIASQRLTPLARGDTLCTNLTGTL

SEQ ID NO: 749 - protein, 18 aa, Homo sapiens
LPSRNTDETFFGVQWVRP

SEQ ID NO: 750 - protein, 42 aa, Homo sapiens
QAQQQLPLESLGWDVAELQLNHTGPQQDPRLYWQGGPALGRS

SEQ ID NO: 751 - protein, 50 aa, Homo sapiens
FLHGPELDKGQLRIHRDGIYMVHIQVTLAICSSTTASRHHPTTLAVGICS

SEQ ID NO: 752 - protein, 42 aa, Homo sapiens
VTLAICSSTTASRHHPTTLAVGICSPASRSISLLRLSFHQGC

SEQ ID NO: 753 - protein, 41 aa, Homo sapiens
PASRSISLLRLSFHQGCTIASQRLTPLARGDTLCTNLTGTL

SEQ ID NO: 754 - protein, 42 aa, Homo sapiens
TIASQRLTPLARGDTLCTNLTGTLLPSRNTDETFFGVQWVRP

SEQ ID NO: 755 - protein, 194 aa, Macaca fascicularis
MPEEGSGCAVRRRPYACVLRAAVVPLVAGLAICLVVCVQRLSRAQQQLPLESLGWDIAELQLNHTGPQQDPRLYWQGGPALGRSFLRGPELDKGQLRIRRDGIYMVHIQVTLAICSSTSTSRHHHPTTLAVGICSPASRSISLLRLSFHQGCTIASQRLTPLARGDTLCTNLTGTLLPSRNTDETFFGVQWVRP

SEQ ID NO: 756 - protein, 152 aa, Macaca fascicularis
RAQQQLPLESLGWDIAELQLNHTGPQQDPRLYWQGGPALGRSFLRGPELDKGQLRIRRDGIYMVHIQVTLAICSSTSTSRHHHPTTLAVGICSPASRSISLLRLSFHQGCTIASQRLTPLARGDTLCTNLTGTLLPSRNTDETFFGVQWVRP

SEQ ID NO: 757 - protein, 195 aa, Mus musculus
MPEEGRPCPWVRWSGTAFQRQWPWLLLVVFITVFCCWFHCSGLLSKQQQRLLEHPEPHTAELQLNLTVPRKDPTLRWGAGPALGRSFTHGPELEEGHLRIHQDGLYRLHIQVTLANCSSPGSTLQHRATLAVGICSPAAHGISLLRGRFGQDCTVALQRLTYLVHGDVLCTNLTLPLLPSRNADETFFGVQWICP

SEQ ID NO: 758 - protein, 151 aa, Mus musculus
SKQQQRLLEHPEPHTAELQLNLTVPRKDPTLRWGAGPALGRSFTHGPELEEGHLRIHQDGLYRLHIQVTLANCSSPGSTLQHRATLAVGICSPAAHGISLLRGRFGQDCTVALQRLTYLVHGDVLCTNLTLPLLPSRNADETFFGVQWICP

SEQ ID NO: 759 - protein, 212 aa, Artificial Sequence
  Synthetic peptide
MPEEGSGCSVRRRPYGCVLRAALVPLVAGLVICLVVCIQRFASKQQQRLLEHPEPHTAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRPGGGGSGKPIPNPLLGLDST

SEQ ID NO: 760 - protein, 212 aa, Artificial Sequence
  Synthetic peptide
MPEEGSGCSVRRRPYGCVLRAALVPLVAGLVICLVVCIQRFAQAQQQLPLESLGWDVAELQLNLTVPRKDPTLRWGAGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRPGGGGSGKPIPNPLLGLDST

SEQ ID NO: 761 - protein, 212 aa, Artificial Sequence
  Synthetic peptide
MPEEGSGCSVRRRPYGCVLRAALVPLVAGLVICLVVCIQRFAQAQQQLPLESLGWDVAELQLNHTGPQQDPRLYWQGGPALGRSFTHGPELEEGHLRIHQDGLYRLHIQVTLAICSSTTASRHHPTTLAVGICSPASRSISLLRLSFHQGCTIASQRLTPLARGDTLCTNLTGTLLPSRNTDETFFGVQWVRPGGGGSGKPIPNPLLGLDST

SEQ ID NO: 762 - protein, 212 aa, Artificial Sequence
  Synthetic peptide
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLANCSSPGSTLQHRATLAVGICSPASRSISLLRLSFHQGCTIASQRLTPLARGDTLCTNLTGTLLPSRNTDETFFGVQWVRPGGGGSGKPIPNPLLGLDST

SEQ ID NO: 763 - protein, 212 aa, Artificial Sequence
  Synthetic peptide
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTVALQRLTYLVHGDVLCTNLTLPLLPSRNTDETFFGVQWVRPGGGGSGKPIPNPLLGLDST

SEQ ID NO: 764 - protein, 212 aa, Artificial Sequence
  Synthetic peptide
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNADETFFGVQWICPGGGGSGKPIPNPLLGLDST

SEQ ID NO: 765 - protein, 212 aa, Artificial Sequence
  Synthetic peptide
MPEEGSGCSVRRRPYGCVLRAALVPLVAGLVICLVVCIQRFASKQQQRLLEHPEPHTAELQLNLTVPRKDPTLRWGAGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRPGGGGSGKPIPNPLLGLDST

SEQ ID NO: 766 - protein, 212 aa, Artificial Sequence
  Synthetic peptide
MPEEGSGCSVRRRPYGCVLRAALVPLVAGLVICLVVCIQRFAQAQQQLPLESLGWDVAELQLNHTGPQQDPRLYWQGGPALGRSFTHGPELEEGHLRIHQDGLYRLHIQVTLANCSSPGSTLQHRATLAVGICSPASRSISLLRLSFHQGCTIASQRLTPLARGDTLCTNLTGTLLPSRNTDETFFGVQWVRPGGGGSGKPIPNPLLGLDST

SEQ ID NO: 767 - protein, 212 aa, Artificial Sequence
  Synthetic peptide
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLANCSSPGSTLQHRATLAVGICSPAAHGISLLRGRFGQDCTIASQRLTPLARGDTLCTNLTGTLLPSRNTDETFFGVQWVRPGGGGSGKPIPNPLLGLDST

SEQ ID NO: 768 - protein, 212 aa, Artificial Sequence
  Synthetic peptide
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTVALQRLTYLVHGDVLCTNLTLPLLPSRNADETFFGVQWICPGGGGSGKPIPNPLLGLDST

SEQ ID NO: 769 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 770 - protein, 4 aa, Artificial Sequence
  Synthetic peptide
GGGG

SEQ ID NO: 771 - protein, 5 aa, Artificial Sequence
  Synthetic peptide
GGGGS

SEQ ID NO: 772 - protein, 5 aa, Artificial Sequence
  Synthetic peptide
GGGGQ

SEQ ID NO: 773 - protein, 6 aa, Artificial Sequence
  Synthetic peptide
SGGGGS

SEQ ID NO: 774 - protein, 6 aa, Artificial Sequence
  Synthetic peptide
PGGGGS

SEQ ID NO: 775 - protein, 6 aa, Artificial Sequence
  Synthetic peptide
PGGDGS

SEQ ID NO: 776 - protein, 9 aa, Artificial Sequence
  Synthetic peptide
GGGGSGGGS

SEQ ID NO: 777 - protein, 10 aa, Artificial Sequence
  Synthetic peptide
GGGGSGGGGS

SEQ ID NO: 778 - protein, 15 aa, Artificial Sequence
  Synthetic peptide
GGGGSGGGGSGGGGS

SEQ ID NO: 779 - protein, 6 aa, Artificial Sequence
  Synthetic peptide
HHHHHH

SEQ ID NO: 780 - protein, 16 aa, Artificial Sequence
  Synthetic peptide
RDWDFDVFGGGTPVGG

SEQ ID NO: 781 - protein, 16 aa, Artificial Sequence
  Synthetic peptide
  misc_feature (12)..(12): Xaa can be any naturally occurring amino acid
QRFVTGHFGGLXPANG

SEQ ID NO: 782 - protein, 16 aa, Artificial Sequence
  Synthetic peptide
QRFVTGHFGGLYPANG

SEQ ID NO: 783 - protein, 16 aa, Artificial Sequence
  Synthetic peptide
QRFVTGHFGGLHPANG

SEQ ID NO: 784 - protein, 9 aa, Artificial Sequence
  Synthetic peptide
TGHFGGLHP

SEQ ID NO: 785 - protein, 16 aa, Artificial Sequence
  Synthetic peptide
QRFCTGHFGGLHPCNG

SEQ ID NO: 786 - protein, 585 aa, Homo sapiens [sequence omitted]

SEQ ID NO: 787 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 788 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 789 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 790 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 791 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 792 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 793 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 794 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 795 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 796 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 797 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 798 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 799 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 800 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 801 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 802 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 803 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 804 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 805 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 806 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 807 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 808 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 809 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 810 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 811 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 812 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 813 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 814 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 815 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 816 - protein, 330 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 817 - protein, 333 aa, Artificial Sequence
  Synthetic peptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 818 - protein, 330 aa, Artificial Sequence
  Synthetic peptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 819 - protein, 338 aa, Artificial Sequence
  Synthetic peptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 820 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 821 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 822 - protein, 232 aa, Artificial Sequence
  Synthetic peptide
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 823 - protein, 232 aa, Artificial Sequence
  Synthetic peptide
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 824 - protein, 232 aa, Artificial Sequence
  Synthetic peptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 825 - protein, 232 aa, Artificial Sequence
  Synthetic peptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 826 - protein, 217 aa, Artificial Sequence
  Synthetic peptide
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 827 - protein, 14 aa, Artificial Sequence
  Synthetic peptide
GSSTGAVTSGYYPN

SEQ ID NO: 828 - protein, 7 aa, Artificial Sequence
  Synthetic peptide
GTKFLAP

SEQ ID NO: 829 - protein, 9 aa, Artificial Sequence
  Synthetic peptide
ALWYSNRWV

SEQ ID NO: 830 - protein, 5 aa, Artificial Sequence
  Synthetic peptide
IYAMN

SEQ ID NO: 831 - protein, 19 aa, Artificial Sequence
  Synthetic peptide
RIRSKYNNYATYYADSVKS

SEQ ID NO: 832 - protein, 14 aa, Artificial Sequence
  Synthetic peptide
HGNFGNSYVSFFAY

SEQ ID NO: 833 - protein, 125 aa, Artificial Sequence
  Synthetic peptide
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 834 - protein, 109 aa, Artificial Sequence
  Synthetic peptide
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 835 - protein, 249 aa, Artificial Sequence
  Synthetic peptide
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 836 - protein, 14 aa, Artificial Sequence
  Synthetic peptide
GSSTGAVTSGYYPN

SEQ ID NO: 837 - protein, 7 aa, Artificial Sequence
  Synthetic peptide
GTKFLAP

SEQ ID NO: 838 - protein, 9 aa, Artificial Sequence
  Synthetic peptide
ALWYSNRWV

SEQ ID NO: 839 - protein, 5 aa, Artificial Sequence
  Synthetic peptide
KYAMN

SEQ ID NO: 840 - protein, 19 aa, Artificial Sequence
  Synthetic peptide
RIRSKYNNYATYYADSVKD

SEQ ID NO: 841 - protein, 14 aa, Artificial Sequence
  Synthetic peptide
HGNFGNSYISYWAY

SEQ ID NO: 842 - protein, 125 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 843 - protein, 109 aa, Artificial Sequence; identical to SEQ ID NO: 834
  Synthetic peptide

SEQ ID NO: 844 - protein, 249 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 845 - protein, 14 aa, Artificial Sequence
  Synthetic peptide
GSSTGAVTSGYYPN

SEQ ID NO: 846 - protein, 7 aa, Artificial Sequence
  Synthetic peptide
GTKFLAP

SEQ ID NO: 847 - protein, 9 aa, Artificial Sequence
  Synthetic peptide
ALWYSNRWV

SEQ ID NO: 848 - protein, 5 aa, Artificial Sequence
  Synthetic peptide
SYAMN

SEQ ID NO: 849 - protein, 19 aa, Artificial Sequence
  Synthetic peptide
RIRSKYNNYATYYADSVKG

SEQ ID NO: 850 - protein, 14 aa, Artificial Sequence
  Synthetic peptide
HGNFGNSYLSFWAY

SEQ ID NO: 851 - protein, 125 aa, Artificial Sequence
  Synthetic peptide
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 852 - protein, 109 aa, Artificial Sequence; identical to SEQ ID NO: 834
  Synthetic peptide

SEQ ID NO: 853 - protein, 249 aa, Artificial Sequence
  Synthetic peptide
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 854 - protein, 14 aa, Artificial Sequence
  Synthetic peptide
GSSTGAVTSGYYPN

SEQ ID NO: 855 - protein, 7 aa, Artificial Sequence
  Synthetic peptide
GTKFLAP

SEQ ID NO: 856 - protein, 9 aa, Artificial Sequence
  Synthetic peptide
ALWYSNRWV

SEQ ID NO: 857 - protein, 5 aa, Artificial Sequence
  Synthetic peptide
RYAMN

SEQ ID NO: 858 - protein, 19 aa, Artificial Sequence
  Synthetic peptide
RIRSKYNNYATYYADSVKG

SEQ ID NO: 859 - protein, 14 aa, Artificial Sequence
  Synthetic peptide
HGNFGNSYLSYFAY

SEQ ID NO: 860 - protein, 125 aa, Artificial Sequence
  Synthetic peptide
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 861 - protein, 109 aa, Artificial Sequence; identical to SEQ ID NO: 834
  Synthetic peptide

SEQ ID NO: 862 - protein, 249 aa, Artificial Sequence
  Synthetic peptide
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 863 - protein, 14 aa, Artificial Sequence
  Synthetic peptide
RSSTGAVTSGYYPN

SEQ ID NO: 864 - protein, 7 aa, Artificial Sequence
  Synthetic peptide
ATDMRPS

SEQ ID NO: 865 - protein, 9 aa, Artificial Sequence
  Synthetic peptide
ALWYSNRWV

SEQ ID NO: 866 - protein, 5 aa, Artificial Sequence
  Synthetic peptide
VYAMN

SEQ ID NO: 867 - protein, 19 aa, Artificial Sequence
  Synthetic peptide
RIRSKYNNYATYYADSVKK

SEQ ID NO: 868 - protein, 14 aa, Artificial Sequence
  Synthetic peptide
HGNFGNSYLSWWAY

SEQ ID NO: 869 - protein, 125 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 870 - protein, 109 aa, Artificial Sequence
  Synthetic peptide
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 871 - protein, 249 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 872 - protein, 14 aa, Artificial Sequence
  Synthetic peptide
GSSTGAVTSGYYPN

SEQ ID NO: 873 - protein, 7 aa, Artificial Sequence
  Synthetic peptide
GTKFLAP

SEQ ID NO: 874 - protein, 9 aa, Artificial Sequence
  Synthetic peptide
ALWYSNRWV

SEQ ID NO: 875 - protein, 5 aa, Artificial Sequence
  Synthetic peptide
KYAMN

SEQ ID NO: 876 - protein, 19 aa, Artificial Sequence
  Synthetic peptide
RIRSKYNNYATYYADSVKS

SEQ ID NO: 877 - protein, 14 aa, Artificial Sequence
  Synthetic peptide
HGNFGNSYTSYYAY

SEQ ID NO: 878 - protein, 125 aa, Artificial Sequence
  Synthetic peptide
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 879 - protein, 109 aa, Artificial Sequence; identical to SEQ ID NO: 834
  Synthetic peptide

SEQ ID NO: 880 - protein, 249 aa, Artificial Sequence
  Synthetic peptide
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 881 - protein, 14 aa, Artificial Sequence
  Synthetic peptide
RSSTGAVTSGYYPN

SEQ ID NO: 882 - protein, 7 aa, Artificial Sequence
  Synthetic peptide
ATDMRPS

SEQ ID NO: 883 - protein, 9 aa, Artificial Sequence
  Synthetic peptide
ALWYSNRWV

SEQ ID NO: 884 - protein, 5 aa, Artificial Sequence
  Synthetic peptide
GYAMN

SEQ ID NO: 885 - protein, 19 aa, Artificial Sequence
  Synthetic peptide
RIRSKYNNYATYYADSVKE

SEQ ID NO: 886 - protein, 14 aa, Artificial Sequence
  Synthetic peptide
HRNFGNSYLSWFAY

SEQ ID NO: 887 - protein, 125 aa, Artificial Sequence
  Synthetic peptide
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 888 - protein, 109 aa, Artificial Sequence; identical to SEQ ID NO: 870
  Synthetic peptide

SEQ ID NO: 889 - protein, 249 aa, Artificial Sequence
  Synthetic peptide
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 890 - protein, 14 aa, Artificial Sequence
  Synthetic peptide
GSSTGAVTSGYYPN

SEQ ID NO: 891 - protein, 7 aa, Artificial Sequence
  Synthetic peptide
GTKFLAP

SEQ ID NO: 892 - protein, 9 aa, Artificial Sequence
  Synthetic peptide
ALWYSNRWV

SEQ ID NO: 893 - protein, 5 aa, Artificial Sequence
  Synthetic peptide
VYAMN

SEQ ID NO: 894 - protein, 19 aa, Artificial Sequence
  Synthetic peptide
RIRSKYNNYATYYADSVKK

SEQ ID NO: 895 - protein, 14 aa, Artificial Sequence
  Synthetic peptide
HGNFGNSYISWWAY

SEQ ID NO: 896 - protein, 125 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 897 - protein, 109 aa, Artificial Sequence; identical to SEQ ID NO: 834
  Synthetic peptide

SEQ ID NO: 898 - protein, 249 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 899 - protein, 14 aa, Artificial Sequence
  Synthetic peptide
GSSTGAVTSGNYPN

SEQ ID NO: 900 - protein, 7 aa, Artificial Sequence
  Synthetic peptide
GTKFLAP

SEQ ID NO: 901 - protein, 9 aa, Artificial Sequence
  Synthetic peptide
VLWYSNRWV

SEQ ID NO: 902 - protein, 5 aa, Artificial Sequence
  Synthetic peptide
SYAMN

SEQ ID NO: 903 - protein, 19 aa, Artificial Sequence
  Synthetic peptide
RIRSKYNNYATYYADSVKG

SEQ ID NO: 904 - protein, 14 aa, Artificial Sequence
  Synthetic peptide
HGNFGNSYVSWWAY

SEQ ID NO: 905 - protein, 125 aa, Artificial Sequence
  Synthetic peptide
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 906 - protein, 109 aa, Artificial Sequence
  Synthetic peptide
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 907 - protein, 249 aa, Artificial Sequence
  Synthetic peptide
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 908 - protein, 14 aa, Artificial Sequence
  Synthetic peptide
GSSTGAVTSGNYPN

SEQ ID NO: 909 - protein, 7 aa, Artificial Sequence
  Synthetic peptide
GTKFLAP

SEQ ID NO: 910 - protein, 9 aa, Artificial Sequence
  Synthetic peptide
VLWYSNRWV

SEQ ID NO: 911 - protein, 5 aa, Artificial Sequence
  Synthetic peptide
KYAMN

SEQ ID NO: 912 - protein, 19 aa, Artificial Sequence
  Synthetic peptide
RIRSKYNNYATYYADSVKD

SEQ ID NO: 913 - protein, 14 aa, Artificial Sequence
  Synthetic peptide
HGNFGNSYISYWAY

SEQ ID NO: 914 - protein, 125 aa, Artificial Sequence; identical to SEQ ID NO: 842
  Synthetic peptide

SEQ ID NO: 915 - protein, 109 aa, Artificial Sequence; identical to SEQ ID NO: 906
  Synthetic peptide

SEQ ID NO: 916 - protein, 249 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 917 - protein, 125 aa, Artificial Sequence
  Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS

SEQ ID NO: 918 - protein, 109 aa, Artificial Sequence; identical to SEQ ID NO: 906
  Synthetic peptide

SEQ ID NO: 919 - protein, 249 aa, Artificial Sequence
  Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 920 - protein, 120 aa, Artificial Sequence
  Synthetic peptide
EVQLLESGGGLVQPGGSLRLSCAASGFTFSSYAMSWVRQAPGKCLEWVSVISGSGGRPNYADSVKGRFTISRDNSKNTLYLQMNSLRDEDTAVYYCAKVDYSNYLFFDYWGQGTLVTVSS

SEQ ID NO: 921 - protein, 108 aa, Artificial Sequence
  Synthetic peptide
EIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIK

SEQ ID NO: 922 - protein, 243 aa, Artificial Sequence
  Synthetic peptide
EVQLLESGGGLVQPGGSLRLSCAASGFTFSSYAMSWVRQAPGKCLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIK

SEQ ID NO: 923 - protein, 498 aa, Artificial Sequence
  Synthetic peptide
EVQLLESGGGLVQPGGSLRLSCAASGFTFSSYAMSWVRQAPGKCLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 924 - protein, 120 aa, Artificial Sequence
  Synthetic peptide
EVQLLESGGGLVQPGGSLKLSCAASGFTFSIYAMSWVRQAPGKCLEWVSAISGSGGSTFYADSVKGRFTISRDNSKNTLYLQMNSLRAEDTAVYYCAKHDYSNYPYFDYWGQGTLVTVSS

SEQ ID NO: 925 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIK

SEQ ID NO: 926 - protein, 243 aa, Artificial Sequence
  Synthetic peptide
EVQLLESGGGLVQPGGSLKLSCAASGFTFSIYAMSWVRQAPGKCLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIK

SEQ ID NO: 927 - protein, 498 aa, Artificial Sequence
  Synthetic peptide
EVQLLESGGGLVQPGGSLKLSCAASGFTFSIYAMSWVRQAPGKCLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 928 - protein, 120 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLFLQMNSLRAEDTAVYYCAKHDYSNYPYFDYWGQGTLVTVSS

SEQ ID NO: 929 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIK

SEQ ID NO: 930 - protein, 243 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIK

SEQ ID NO: 931 - protein, 498 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 932 - protein, 120 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSS

SEQ ID NO: 933 - protein, 108 aa, Artificial Sequence
  Synthetic peptide
EIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIK

SEQ ID NO: 934 - protein, 243 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIK

SEQ ID NO: 935 - protein, 498 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 936 - protein, 120 aa, Artificial Sequence
  Synthetic peptide
EVQLLESGGGLVQSGGSLRLSCAASGFTFSSYAMSWVRQAPGKCLEWVSAISGSGGRTHYADSVKGRFTISRDNSKNTLYLQMNSLRAEDTAVYYCAKHDYSNYPYFDYWGQGTLVTVSS

SEQ ID NO: 937 - protein, 108 aa, Artificial Sequence; identical to SEQ ID NO: 929
  Synthetic peptide

SEQ ID NO: 938 - protein, 243 aa, Artificial Sequence
  Synthetic peptide
EVQLLESGGGLVQSGGSLRLSCAASGFTFSSYAMSWVRQAPGKCLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIK

SEQ ID NO: 939 - protein, 498 aa, Artificial Sequence
  Synthetic peptide
EVQLLESGGGLVQSGGSLRLSCAASGFTFSSYAMSWVRQAPGKCLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 940 - protein, 120 aa, Artificial Sequence
  Synthetic peptide
EVQLLESGGGLVQPGGSLRLSCAASGFTFSSYAMSWVRQAPGKCLEWVSLISGSGGRTHYADSVKGRFTISRDNSKNTLYLQMNSLRAEDTAVYYCAKHDYSNYPYFDYWGQGTLVTVSS

SEQ ID NO: 941 - protein, 108 aa, Artificial Sequence
  Synthetic peptide
EIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIK

SEQ ID NO: 942 - protein, 243 aa, Artificial Sequence
  Synthetic peptide
EVQLLESGGGLVQPGGSLRLSCAASGFTFSSYAMSWVRQAPGKCLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIK

SEQ ID NO: 943 - protein, 498 aa, Artificial Sequence
  Synthetic peptide
EVQLLESGGGLVQPGGSLRLSCAASGFTFSSYAMSWVRQAPGKCLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 944 - protein, 120 aa, Artificial Sequence
  Synthetic peptide
EVQLLESGGGLVQPGGSLRLSCAASGFTFSTYAMSWVRQAPGKCLEWVSAISGSGGSTFYADSVKGRFTISRDNSKNTLSLQMNSLRAEDTAVYYCAKHDYSNYPYFDYWGQGTLVTVSS

SEQ ID NO: 945 - protein, 108 aa, Artificial Sequence; identical to SEQ ID NO: 925
  Synthetic peptide

SEQ ID NO: 946 - protein, 243 aa, Artificial Sequence
  Synthetic peptide
EVQLLESGGGLVQPGGSLRLSCAASGFTFSTYAMSWVRQAPGKCLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIK

SEQ ID NO: 947 - protein, 498 aa, Artificial Sequence
  Synthetic peptide
EVQLLESGGGLVQPGGSLRLSCAASGFTFSTYAMSWVRQAPGKCLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 948 - protein, 119 aa, Artificial Sequence
  Synthetic peptide
EVQLLESGGGMVQPGGSLRLSCAASGFTFSTYAMSWVRQAPGKCLEWVSAISGSGGRTFYADSVEGRFTISRDNSKNTLYLQMNSLRAEDTAVYYCAKHDYSNYPYFDYWGQGTLVTVS

SEQ ID NO: 949 - protein, 108 aa, Artificial Sequence
  Synthetic peptide
EIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIK

SEQ ID NO: 950 - protein, 243 aa, Artificial Sequence
  Synthetic peptide
EVQLLESGGGMVQPGGSLRLSCAASGFTFSTYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIK

SEQ ID NO: 951 - protein, 498 aa, Artificial Sequence
  Synthetic peptide
EVQLLESGGGMVQPGGSLRLSCAASGFTFSTYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 952 - protein, 120 aa, Artificial Sequence
  Synthetic peptide
EVQLLESGGGLVQPGGSLRLSCAASGFTFSSYAMSWVRQAPGKCLEWVSAISGSGGYTYYADSVKGRFTISRDNSKNTLYLQMNSLRAEDTAVYYCAKHDYSNYPYFDYWGQGTLVTVSS

SEQ ID NO: 953 - protein, 108 aa, Artificial Sequence
  Synthetic peptide
EIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIK

SEQ ID NO: 954 - protein, 243 aa, Artificial Sequence
  Synthetic peptide
EVQLLESGGGLVQPGGSLRLSCAASGFTFSSYAMSWVRQAPGKCLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIK

SEQ ID NO: 955 - protein, 498 aa, Artificial Sequence
  Synthetic peptide
EVQLLESGGGLVQPGGSLRLSCAASGFTFSSYAMSWVRQAPGKCLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 956 - protein, 120 aa, Artificial Sequence
  Synthetic peptide
EVQLLESGGGLAQPGGSLRLSCAASGFTFSSYAMSWVRQAPGKCLEWVSAISGSGGSTFYADSVKGRFTISRDNSKNTLYLQMNSLRAEDTAVYFCAKHDYSNYPYFDYWGQGTLVTVSS

SEQ ID NO: 957 - protein, 108 aa, Artificial Sequence; identical to SEQ ID NO: 638
  Synthetic peptide

SEQ ID NO: 958 - protein, 243 aa, Artificial Sequence
  Synthetic peptide
EVQLLESGGGLAQPGGSLRLSCAASGFTFSSYAMSWVRQAPGKCLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 959 - protein, 498 aa, Artificial Sequence
  Synthetic peptide
EVQLLESGGGLAQPGGSLRLSCAASGFTFSSYAMSWVRQAPGKCLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 960 - protein, 120 aa, Artificial Sequence; identical to SEQ ID NO: 932
  Synthetic peptide

SEQ ID NO: 961 - protein, 108 aa, Artificial Sequence; identical to SEQ ID NO: 953
  Synthetic peptide

SEQ ID NO: 962 - protein, 243 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIK

SEQ ID NO: 963 - protein, 498 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 964 - protein, 120 aa, Artificial Sequence; identical to SEQ ID NO: 932
  Synthetic peptide

SEQ ID NO: 965 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIK

SEQ ID NO: 966 - protein, 243 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIK

SEQ ID NO: 967 - protein, 498 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 968 - protein, 120 aa, Artificial Sequence; identical to SEQ ID NO: 737
  Synthetic peptide

SEQ ID NO: 969 - protein, 108 aa, Artificial Sequence
  Synthetic peptide
EIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIK

SEQ ID NO: 970 - protein, 243 aa, Artificial Sequence
  Synthetic peptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIK

SEQ ID NO: 971 - protein, 498 aa, Artificial Sequence
  Synthetic peptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 972 - protein, 120 aa, Artificial Sequence
  Synthetic peptide
EVQLLESGGGLVQPGGSLRLSCAASGFTFSSYAMSWVRQAPGKCLEWVSAISGSGGSTFYADSVQGRFTISRDNSKNTLYLQVNSLRAEDTAVYYCARHDYSNYPYFDYWGQGTLVTVSS

SEQ ID NO: 973 - protein, 108 aa, Artificial Sequence
  Synthetic peptide
EIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIK

SEQ ID NO: 974 - protein, 243 aa, Artificial Sequence
  Synthetic peptide
EVQLLESGGGLVQPGGSLRLSCAASGFTFSSYAMSWVRQAPGKCLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIK

SEQ ID NO: 975 - protein, 498 aa, Artificial Sequence
  Synthetic peptide
EVQLLESGGGLVQPGGSLRLSCAASGFTFSSYAMSWVRQAPGKCLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 976 - protein, 120 aa, Artificial Sequence
  Synthetic peptide
EVQLLESGGGLVQPGGSLRLSCAASGFTFSTYAMSWVRQAPGKCLEWVSAISGSGGGTFYADSVKGRFTISRDNSKNTLYLQMNSLRAEDTAVYYCAKHDYSNYPYFDYWGQGTLVTVSS

SEQ ID NO: 977 - protein, 108 aa, Artificial Sequence
  Synthetic peptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIK

SEQ ID NO: 978 - protein, 243 aa, Artificial Sequence
  Synthetic peptide
EVQLLESGGGLVQPGGSLRLSCAASGFTFSTYAMSWVRQAPGKCLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIK

SEQ ID NO: 979 - protein, 498 aa, Artificial Sequence
  Synthetic peptide
EVQLLESGGGLVQPGGSLRLSCAASGFTFSTYAMSWVRQAPGKCLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 980 - protein, 120 aa, Artificial Sequence
  Synthetic peptide
EVQLLESGGGLVQPGGSLRLSCAASGFTFSTYAMSWVRQAPGKCLEWVSLISGSGGRTYYADSVKGRFTISRDNSKNTLYLQMNSLRAEDTAVYYCAKHDYSNYPYFDYWGQGTLVTVSS

SEQ ID NO: 981 - protein, 108 aa, Artificial Sequence
  Synthetic peptide
EIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIK

SEQ ID NO: 982 - protein, 243 aa, Artificial Sequence
  Synthetic peptide
EVQLLESGGGLVQPGGSLRLSCAASGFTFSTYAMSWVRQAPGKCLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIK

SEQ ID NO: 983 - protein, 498 aa, Artificial Sequence
  Synthetic peptide
EVQLLESGGGLVQPGGSLRLSCAASGFTFSTYAMSWVRQAPGKCLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 984 - protein, 120 aa, Artificial Sequence
  Synthetic peptide
EVQLLESGGGLVQPGGSLRLSCAASGFTFSSYAMSWVRQSPGKCLEWVSAISGSGGRAQYADSVQGRFTVSRDNSKNTLYLQMNSLRAEDTAVYYCAKHDYSNYPYFDYWGQGTLVTVSS

SEQ ID NO: 985 - protein, 107 aa, Artificial Sequence
  Synthetic peptide
EIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIK

SEQ ID NO: 986 - protein, 242 aa, Artificial Sequence
  Synthetic peptide
EVQLLESGGGLVQPGGSLRLSCAASGFTFSSYAMSWVRQSPGKCLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIK

SEQ ID NO: 987 - protein, 497 aa, Artificial Sequence
  Synthetic peptide
EVQLLESGGGLVQPGGSLRLSCAASGFTFSSYAMSWVRQSPGKCLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 988 - protein, 120 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCTKHDYSNYPYFDYWGQGTLVTVSS

SEQ ID NO: 989 - protein, 108 aa, Artificial Sequence
  Synthetic peptide
EIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIK

SEQ ID NO: 990 - protein, 243 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIK

SEQ ID NO: 991 - protein, 498 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 992 - protein, 120 aa, Artificial Sequence
  Synthetic peptide
EVQLLESGGGLVQPGGSLRLSCAASGFTFSSYAMSWVRQAPGKCLEWVSAIGDGGGYTYYADSVKGRFTISRDNSKNTLSLLMNSLRAEDTAVYYCARHDYSNYPYFDYWGQGTLVTVSS

SEQ ID NO: 993 - protein, 108 aa, Artificial Sequence
  Synthetic peptide
EIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIK

SEQ ID NO: 994 - protein, 243 aa, Artificial Sequence
  Synthetic peptide
EVQLLESGGGLVQPGGSLRLSCAASGFTFSSYAMSWVRQAPGKCLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIK

SEQ ID NO: 995 - protein, 498 aa, Artificial Sequence
  Synthetic peptide
EVQLLESGGGLVQPGGSLRLSCAASGFTFSSYAMSWVRQAPGKCLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 996 - protein, 120 aa, Artificial Sequence
  Synthetic peptide
EVQLLESGGGVVQPGRSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSS

SEQ ID NO: 997 - protein, 108 aa, Artificial Sequence
  Synthetic peptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIK

SEQ ID NO: 998 - protein, 243 aa, Artificial Sequence
  Synthetic peptide
EVQLLESGGGVVQPGRSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIK

SEQ ID NO: 999 - protein, 498 aa, Artificial Sequence
  Synthetic peptide
EVQLLESGGGVVQPGRSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1000 - protein, 120 aa, Artificial Sequence
  Synthetic peptide
EVQLLESGGGVVQPGRSLRLSCAASGFTFSSYAMSWVRQAPGKCLEWVSAISGSGGGTFYADSVEGRFTISRDNSKNTLYLQMNSLRAEDTAVYYCARHDYSNYPYFDYWGLGTLVTVSS

SEQ ID NO: 1001 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIK

SEQ ID NO: 1002 - protein, 243 aa, Artificial Sequence
  Synthetic peptide
EVQLLESGGGVVQPGRSLRLSCAASGFTFSSYAMSWVRQAPGKCLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIK

SEQ ID NO: 1003 - protein, 498 aa, Artificial Sequence
  Synthetic peptide
EVQLLESGGGVVQPGRSLRLSCAASGFTFSSYAMSWVRQAPGKCLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1004 - protein, 120 aa, Artificial Sequence; identical to SEQ ID NO: 988
  Synthetic peptide

SEQ ID NO: 1005 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIK

SEQ ID NO: 1006 - protein, 243 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIK

SEQ ID NO: 1007 - protein, 498 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1008 - protein, 120 aa, Artificial Sequence; identical to SEQ ID NO: 980
  Synthetic peptide

SEQ ID NO: 1009 - protein, 108 aa, Artificial Sequence
  Synthetic peptide
EIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIK

SEQ ID NO: 1010 - protein, 243 aa, Artificial Sequence
  Synthetic peptide
EVQLLESGGGLVQPGGSLRLSCAASGFTFSTYAMSWVRQAPGKCLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIK

SEQ ID NO: 1011 - protein, 498 aa, Artificial Sequence
  Synthetic peptide
EVQLLESGGGLVQPGGSLRLSCAASGFTFSTYAMSWVRQAPGKCLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1012 - protein, 120 aa, Artificial Sequence; identical to SEQ ID NO: 996
  Synthetic peptide

SEQ ID NO: 1013 - protein, 108 aa, Artificial Sequence
  Synthetic peptide
EIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIK

SEQ ID NO: 1014 - protein, 243 aa, Artificial Sequence
  Synthetic peptide
EVQLLESGGGVVQPGRSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIK

SEQ ID NO: 1015 - protein, 498 aa, Artificial Sequence
  Synthetic peptide
EVQLLESGGGVVQPGRSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1016 - protein, 120 aa, Artificial Sequence; identical to SEQ ID NO: 677
  Synthetic peptide

SEQ ID NO: 1017 - protein, 107 aa, Artificial Sequence; identical to SEQ ID NO: 678
  Synthetic peptide

SEQ ID NO: 1018 - protein, 242 aa, Artificial Sequence; identical to SEQ ID NO: 679
  Synthetic peptide

SEQ ID NO: 1019 - protein, 497 aa, Artificial Sequence; identical to SEQ ID NO: 680
  Synthetic peptide

SEQ ID NO: 1020 - protein, 120 aa, Artificial Sequence; identical to SEQ ID NO: 932
  Synthetic peptide

SEQ ID NO: 1021 - protein, 108 aa, Artificial Sequence
  Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIK

SEQ ID NO: 1022 - protein, 243 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIK

SEQ ID NO: 1023 - protein, 498 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1024 - protein, 120 aa, Artificial Sequence
  Synthetic peptide
EVQLLESGGGLVQPGGSLRLSCAASGFTFSIYAMSWVRQAPGKCLEWVSAIGDSGGSTFYADSVKGRFTISRDNSKNTLYLQMNSLRAEDTAVYYCAKHDYSNYPYFDYWGQGTLVTVSS

SEQ ID NO: 1025 - protein, 108 aa, Artificial Sequence
  Synthetic peptide
EIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIK

SEQ ID NO: 1026 - protein, 243 aa, Artificial Sequence
  Synthetic peptide
EVQLLESGGGLVQPGGSLRLSCAASGFTFSIYAMSWVRQAPGKCLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIK

SEQ ID NO: 1027 - protein, 498 aa, Artificial Sequence
  Synthetic peptide
EVQLLESGGGLVQPGGSLRLSCAASGFTFSIYAMSWVRQAPGKCLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1028 - protein, 125 aa, Artificial Sequence
  Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSS

SEQ ID NO: 1029 - protein, 107 aa, Artificial Sequence
  Synthetic peptide
DIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIK

SEQ ID NO: 1030 - protein, 247 aa, Artificial Sequence
  Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIK

SEQ ID NO: 1031 - protein, 502 aa, Artificial Sequence
  Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1032 - protein, 120 aa, Artificial Sequence; identical to SEQ ID NO: 727
  Synthetic peptide

SEQ ID NO: 1033 - protein, 107 aa, Artificial Sequence; identical to SEQ ID NO: 728
  Synthetic peptide

SEQ ID NO: 1034 - protein, 242 aa, Artificial Sequence; identical to SEQ ID NO: 729
  Synthetic peptide

SEQ ID NO: 1035 - protein, 497 aa, Artificial Sequence; identical to SEQ ID NO: 730
  Synthetic peptide

SEQ ID NO: 1036 - protein, 120 aa, Artificial Sequence; identical to SEQ ID NO: 637
  Synthetic peptide

SEQ ID NO: 1037 - protein, 108 aa, Artificial Sequence; identical to SEQ ID NO: 638
  Synthetic peptide

SEQ ID NO: 1038 - protein, 243 aa, Artificial Sequence; identical to SEQ ID NO: 639
  Synthetic peptide

SEQ ID NO: 1039 - protein, 498 aa, Artificial Sequence; identical to SEQ ID NO: 640
  Synthetic peptide

SEQ ID NO: 1040 - protein, 124 aa, Artificial Sequence; identical to SEQ ID NO: 697
  Synthetic peptide

SEQ ID NO: 1041 - protein, 107 aa, Artificial Sequence; identical to SEQ ID NO: 698
  Synthetic peptide

SEQ ID NO: 1042 - protein, 246 aa, Artificial Sequence; identical to SEQ ID NO: 699
  Synthetic peptide

SEQ ID NO: 1043 - protein, 501 aa, Artificial Sequence; identical to SEQ ID NO: 700
  Synthetic peptide

SEQ ID NO: 1044 - protein, 5 aa, Artificial Sequence
  Synthetic peptide
SYAMS

SEQ ID NO: 1045 - protein, 17 aa, Artificial Sequence
  Synthetic peptide
VISGSGGRPNYAESVKG

SEQ ID NO: 1046 - protein, 11 aa, Artificial Sequence
  Synthetic peptide
VDYSNYLFFDY

SEQ ID NO: 1047 - protein, 12 aa, Artificial Sequence
  Synthetic peptide
RAGQSVRSSYLG

SEQ ID NO: 1048 - protein, 7 aa, Artificial Sequence
  Synthetic peptide
GASSRAT

SEQ ID NO: 1049 - protein, 9 aa, Artificial Sequence
  Synthetic peptide
QQYGYSPPT

SEQ ID NO: 1050 - protein, 120 aa, Artificial Sequence
  Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSS

SEQ ID NO: 1051 - protein, 108 aa, Artificial Sequence; identical to SEQ ID NO: 921
  Synthetic peptide

SEQ ID NO: 1052 - protein, 243 aa, Artificial Sequence
  Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIK

SEQ ID NO: 1053 - protein, 498 aa, Artificial Sequence
  Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1054 - protein, 120 aa, Artificial Sequence
  Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSS

SEQ ID NO: 1055 - protein, 108 aa, Artificial Sequence; identical to SEQ ID NO: 128
  Synthetic peptide

SEQ ID NO: 1056 - protein, 243 aa, Artificial Sequence
  Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIK

SEQ ID NO: 1057 - protein, 498 aa, Artificial Sequence
  Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1058 - protein, 5 aa, Artificial Sequence
  Synthetic peptide
IYAMS

SEQ ID NO: 1059 - protein, 17 aa, Artificial Sequence
  Synthetic peptide
AISGSGGSTFYAESVKG

SEQ ID NO: 1060 - protein, 11 aa, Artificial Sequence
  Synthetic peptide
HDYSNYPYFDY

SEQ ID NO: 1061 - protein, 12 aa, Artificial Sequence
  Synthetic peptide
RASQSVRSSYLA

SEQ ID NO: 1062 - protein, 7 aa, Artificial Sequence
  Synthetic peptide
GASSRAT

SEQ ID NO: 1063 - protein, 9 aa, Artificial Sequence
  Synthetic peptide
QQYGDLPFT

SEQ ID NO: 1064 - protein, 120 aa, Artificial Sequence
  Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSS

SEQ ID NO: 1065 - protein, 108 aa, Artificial Sequence; identical to SEQ ID NO: 925
  Synthetic peptide

SEQ ID NO: 1066 - protein, 243 aa, Artificial Sequence
  Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIK

SEQ ID NO: 1067 - protein, 498 aa, Artificial Sequence
  Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1068 - protein, 120 aa, Artificial Sequence
  Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSS

SEQ ID NO: 1069 - protein, 108 aa, Artificial Sequence; identical to SEQ ID NO: 138
  Synthetic peptide

SEQ ID NO: 1070 - protein, 243 aa, Artificial Sequence
  Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 1071 - protein, 498 aa, Artificial Sequence
  Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1072 - protein, 5 aa, Artificial Sequence
  Synthetic peptide
SYAMS

SEQ ID NO: 1073 - protein, 17 aa, Artificial Sequence
  Synthetic peptide
AISGSGGRTFYAESVEG

SEQ ID NO: 1074 - protein, 11 aa, Artificial Sequence
  Synthetic peptide
HDYSNYPYFDY

SEQ ID NO: 1075 - protein, 12 aa, Artificial Sequence
  Synthetic peptide
RASQSVRSSYLA

SEQ ID NO: 1076 - protein, 7 aa, Artificial Sequence
  Synthetic peptide
GASSRAT

SEQ ID NO: 1077 - protein, 9 aa, Artificial Sequence
  Synthetic peptide
QQYGSSPFT

SEQ ID NO: 1078 - protein, 120 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSS

SEQ ID NO: 1079 - protein, 108 aa, Artificial Sequence; identical to SEQ ID NO: 929
  Synthetic peptide

SEQ ID NO: 1080 - protein, 243 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIK

SEQ ID NO: 1081 - protein, 498 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1082 - protein, 120 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSS

SEQ ID NO: 1083 - protein, 108 aa, Artificial Sequence; identical to SEQ ID NO: 148
  Synthetic peptide

SEQ ID NO: 1084 - protein, 243 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 1085 - protein, 498 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1086 - protein, 5 aa, Artificial Sequence
  Synthetic peptide
SYAMS

SEQ ID NO: 1087 - protein, 17 aa, Artificial Sequence
  Synthetic peptide
AISGSGGRTFYAESVEG

SEQ ID NO: 1088 - protein, 11 aa, Artificial Sequence
  Synthetic peptide
HDYSNYPYFDY

SEQ ID NO: 1089 - protein, 12 aa, Artificial Sequence
  Synthetic peptide
RASQSIRSSYLA

SEQ ID NO: 1090 - protein, 7 aa, Artificial Sequence
  Synthetic peptide
GASSRAT

SEQ ID NO: 1091 - protein, 9 aa, Artificial Sequence
  Synthetic peptide
QQYGDLPFT

SEQ ID NO: 1092 - protein, 120 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSS

SEQ ID NO: 1093 - protein, 108 aa, Artificial Sequence; identical to SEQ ID NO: 933
  Synthetic peptide

SEQ ID NO: 1094 - protein, 243 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIK

SEQ ID NO: 1095 - protein, 498 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1096 - protein, 120 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSS

SEQ ID NO: 1097 - protein, 108 aa, Artificial Sequence; identical to SEQ ID NO: 158
  Synthetic peptide

SEQ ID NO: 1098 - protein, 243 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIK

SEQ ID NO: 1099 - protein, 498 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1100 - protein, 5 aa, Artificial Sequence
  Synthetic peptide
SYAMS

SEQ ID NO: 1101 - protein, 17 aa, Artificial Sequence
  Synthetic peptide
AISGSGGRTHYAESVKG

SEQ ID NO: 1102 - protein, 11 aa, Artificial Sequence
  Synthetic peptide
HDYSNYPYFDY

SEQ ID NO: 1103 - protein, 12 aa, Artificial Sequence
  Synthetic peptide
RASQSVRSSYLA

SEQ ID NO: 1104 - protein, 7 aa, Artificial Sequence
  Synthetic peptide
GASSRAT

SEQ ID NO: 1105 - protein, 9 aa, Artificial Sequence
  Synthetic peptide
QQYGSSPFT

SEQ ID NO: 1106 - protein, 120 aa, Artificial Sequence
  Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSS

SEQ ID NO: 1107 - protein, 108 aa, Artificial Sequence; identical to SEQ ID NO: 929
  Synthetic peptide

SEQ ID NO: 1108 - protein, 243 aa, Artificial Sequence
  Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIK

SEQ ID NO: 1109 - protein, 498 aa, Artificial Sequence
  Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1110 - protein, 120 aa, Artificial Sequence
  Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSS

SEQ ID NO: 1111 - protein, 108 aa, Artificial Sequence; identical to SEQ ID NO: 148
  Synthetic peptide

SEQ ID NO: 1112 - protein, 243 aa, Artificial Sequence
  Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 1113 - protein, 498 aa, Artificial Sequence
  Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1114 - protein, 5 aa, Artificial Sequence
  Synthetic peptide
SYAMS

SEQ ID NO: 1115 - protein, 17 aa, Artificial Sequence
  Synthetic peptide
LISGSGGRTHYAESVKG

SEQ ID NO: 1116 - protein, 11 aa, Artificial Sequence
  Synthetic peptide
HDYSNYPYFDY

SEQ ID NO: 1117 - protein, 12 aa, Artificial Sequence
  Synthetic peptide
RASQSVRSTYLA

SEQ ID NO: 1118 - protein, 7 aa, Artificial Sequence
  Synthetic peptide
DASSRAT

SEQ ID NO: 1119 - protein, 9 aa, Artificial Sequence
  Synthetic peptide
QQYGSSPPT

SEQ ID NO: 1120 - protein, 120 aa, Artificial Sequence
  Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSS

SEQ ID NO: 1121 - protein, 108 aa, Artificial Sequence; identical to SEQ ID NO: 941
  Synthetic peptide

SEQ ID NO: 1122 - protein, 243 aa, Artificial Sequence
  Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIK

SEQ ID NO: 1123 - protein, 498 aa, Artificial Sequence
  Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1124 - protein, 120 aa, Artificial Sequence
  Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSS

SEQ ID NO: 1125 - protein, 108 aa, Artificial Sequence; identical to SEQ ID NO: 178
  Synthetic peptide

SEQ ID NO: 1126 - protein, 243 aa, Artificial Sequence
  Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIK

SEQ ID NO: 1127 - protein, 498 aa, Artificial Sequence
  Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1128 - protein, 5 aa, Artificial Sequence
  Synthetic peptide
TYAMS

SEQ ID NO: 1129 - protein, 17 aa, Artificial Sequence
  Synthetic peptide
AISGSGGSTFYAESVKG

SEQ ID NO: 1130 - protein, 11 aa, Artificial Sequence
  Synthetic peptide
HDYSNYPYFDY

SEQ ID NO: 1131 - protein, 12 aa, Artificial Sequence
  Synthetic peptide
RASQSVRSSYLA

SEQ ID NO: 1132 - protein, 7 aa, Artificial Sequence
  Synthetic peptide
GASSRAT

SEQ ID NO: 1133 - protein, 9 aa, Artificial Sequence
  Synthetic peptide
QQYGDLPFT

SEQ ID NO: 1134 - protein, 120 aa, Artificial Sequence
  Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSS

SEQ ID NO: 1135 - protein, 108 aa, Artificial Sequence; identical to SEQ ID NO: 925
  Synthetic peptide

SEQ ID NO: 1136 - protein, 243 aa, Artificial Sequence
  Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIK

SEQ ID NO: 1137 - protein, 498 aa, Artificial Sequence
  Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1138 - protein, 120 aa, Artificial Sequence
  Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSS

SEQ ID NO: 1139 - protein, 108 aa, Artificial Sequence; identical to SEQ ID NO: 138
  Synthetic peptide

SEQ ID NO: 1140 - protein, 243 aa, Artificial Sequence
  Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 1141 - protein, 498 aa, Artificial Sequence
  Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1142 - protein, 5 aa, Artificial Sequence
  Synthetic peptide
TYAMS

SEQ ID NO: 1143 - protein, 17 aa, Artificial Sequence
  Synthetic peptide
AISGSGGRTFYAESVEG

SEQ ID NO: 1144 - protein, 11 aa, Artificial Sequence
  Synthetic peptide
HDYSNYPYFDY

SEQ ID NO: 1145 - protein, 12 aa, Artificial Sequence
  Synthetic peptide
RASQSVRSTYLA

SEQ ID NO: 1146 - protein, 7 aa, Artificial Sequence
  Synthetic peptide
GASSRAT

SEQ ID NO: 1147 - protein, 9 aa, Artificial Sequence
  Synthetic peptide
QQYGDLPFT

SEQ ID NO: 1148 - protein, 120 aa, Artificial Sequence
  Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSS

SEQ ID NO: 1149 - protein, 108 aa, Artificial Sequence; identical to SEQ ID NO: 949
  Synthetic peptide

SEQ ID NO: 1150 - protein, 243 aa, Artificial Sequence
  Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIK

SEQ ID NO: 1151 - protein, 498 aa, Artificial Sequence
  Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1152 - protein, 120 aa, Artificial Sequence
  Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSS

SEQ ID NO: 1153 - protein, 108 aa, Artificial Sequence; identical to SEQ ID NO: 208
  Synthetic peptide

SEQ ID NO: 1154 - protein, 243 aa, Artificial Sequence
  Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIK

SEQ ID NO: 1155 - protein, 498 aa, Artificial Sequence
  Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1156 - protein, 5 aa, Artificial Sequence
  Synthetic peptide
SYAMS

SEQ ID NO: 1157 - protein, 17 aa, Artificial Sequence
  Synthetic peptide
AISGSGGYTYYAESVKG

SEQ ID NO: 1158 - protein, 11 aa, Artificial Sequence
  Synthetic peptide
HDYSNYPYFDY

SEQ ID NO: 1159 - protein, 12 aa, Artificial Sequence
  Synthetic peptide
RASQSVRSNYLA

SEQ ID NO: 1160 - protein, 7 aa, Artificial Sequence
  Synthetic peptide
GASSRAT

SEQ ID NO: 1161 - protein, 9 aa, Artificial Sequence
  Synthetic peptide
QQYGDLPFT

SEQ ID NO: 1162 - protein, 120 aa, Artificial Sequence
  Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSS

SEQ ID NO: 1163 - protein, 108 aa, Artificial Sequence; identical to SEQ ID NO: 953
  Synthetic peptide

SEQ ID NO: 1164 - protein, 243 aa, Artificial Sequence
  Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIK

SEQ ID NO: 1165 - protein, 498 aa, Artificial Sequence
  Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1166 - protein, 120 aa, Artificial Sequence
  Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSS

SEQ ID NO: 1167 - protein, 108 aa, Artificial Sequence; identical to SEQ ID NO: 218
  Synthetic peptide

SEQ ID NO: 1168 - protein, 243 aa, Artificial Sequence
  Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 1169 - protein, 498 aa, Artificial Sequence
  Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1170 - protein, 5 aa, Artificial Sequence
  Synthetic peptide
SYAMS

SEQ ID NO: 1171 - protein, 17 aa, Artificial Sequence
  Synthetic peptide
AISGSGGSTFYAESVKG

SEQ ID NO: 1172 - protein, 11 aa, Artificial Sequence
  Synthetic peptide
HDYSNYPYFDY

SEQ ID NO: 1173 - protein, 12 aa, Artificial Sequence
  Synthetic peptide
RASQSVRSSYLA

SEQ ID NO: 1174 - protein, 7 aa, Artificial Sequence
  Synthetic peptide
GASSRAT

SEQ ID NO: 1175 - protein, 9 aa, Artificial Sequence
  Synthetic peptide
QQYGDLPFT

SEQ ID NO: 1176 - protein, 120 aa, Artificial Sequence
  Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSS

SEQ ID NO: 1177 - protein, 108 aa, Artificial Sequence; identical to SEQ ID NO: 638
  Synthetic peptide

SEQ ID NO: 1178 - protein, 243 aa, Artificial Sequence
  Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 1179 - protein, 498 aa, Artificial Sequence
  Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1180 - protein, 120 aa, Artificial Sequence
  Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSS

SEQ ID NO: 1181 - protein, 108 aa, Artificial Sequence; identical to SEQ ID NO: 228
  Synthetic peptide

SEQ ID NO: 1182 - protein, 243 aa, Artificial Sequence
  Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 1183 - protein, 498 aa, Artificial Sequence
  Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1184 - protein, 5 aa, Artificial Sequence
  Synthetic peptide
SYAMS

SEQ ID NO: 1185 - protein, 17 aa, Artificial Sequence
  Synthetic peptide
AISGSGGRTFYAESVEG

SEQ ID NO: 1186 - protein, 11 aa, Artificial Sequence
  Synthetic peptide
HDYSNYPYFDY

SEQ ID NO: 1187 - protein, 12 aa, Artificial Sequence
  Synthetic peptide
RASQSVRSNYLA

SEQ ID NO: 1188 - protein, 7 aa, Artificial Sequence
  Synthetic peptide
GASSRAT

SEQ ID NO: 1189 - protein, 9 aa, Artificial Sequence
  Synthetic peptide
QQYGDLPFT

SEQ ID NO: 1190 - protein, 120 aa, Artificial Sequence; identical to SEQ ID NO: 1092
  Synthetic peptide

SEQ ID NO: 1191 - protein, 108 aa, Artificial Sequence; identical to SEQ ID NO: 953
  Synthetic peptide

SEQ ID NO: 1192 - protein, 243 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIK

SEQ ID NO: 1193 - protein, 498 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1194 - protein, 120 aa, Artificial Sequence; identical to SEQ ID NO: 1096
  Synthetic peptide

SEQ ID NO: 1195 - protein, 108 aa, Artificial Sequence; identical to SEQ ID NO: 218
  Synthetic peptide

SEQ ID NO: 1196 - protein, 243 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 1197 - protein, 498 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1198 - protein, 5 aa, Artificial Sequence
  Synthetic peptide
SYAMS

SEQ ID NO: 1199 - protein, 17 aa, Artificial Sequence
  Synthetic peptide
AISGSGGRTFYAESVEG

SEQ ID NO: 1200 - protein, 11 aa, Artificial Sequence
  Synthetic peptide
HDYSNYPYFDY

SEQ ID NO: 1201 - protein, 12 aa, Artificial Sequence
  Synthetic peptide
RASQSVRSSYLA

SEQ ID NO: 1202 - protein, 7 aa, Artificial Sequence
  Synthetic peptide
GASSRAT

SEQ ID NO: 1203 - protein, 9 aa, Artificial Sequence
  Synthetic peptide
QQYGSSPFT

SEQ ID NO: 1204 - protein, 120 aa, Artificial Sequence; identical to SEQ ID NO: 1092
  Synthetic peptide

SEQ ID NO: 1205 - protein, 108 aa, Artificial Sequence; identical to SEQ ID NO: 965
  Synthetic peptide

SEQ ID NO: 1206 - protein, 243 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIK

SEQ ID NO: 1207 - protein, 498 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1208 - protein, 120 aa, Artificial Sequence; identical to SEQ ID NO: 1096
  Synthetic peptide

SEQ ID NO: 1209 - protein, 108 aa, Artificial Sequence; identical to SEQ ID NO: 258
  Synthetic peptide

SEQ ID NO: 1210 - protein, 243 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIK

SEQ ID NO: 1211 - protein, 498 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1212 - protein, 5 aa, Artificial Sequence
  Synthetic peptide
SYAMS

SEQ ID NO: 1213 - protein, 17 aa, Artificial Sequence
  Synthetic peptide
AISGSGGSTFYAESVQG

SEQ ID NO: 1214 - protein, 11 aa, Artificial Sequence
  Synthetic peptide
HDYSNYPYFDY

SEQ ID NO: 1215 - protein, 12 aa, Artificial Sequence
  Synthetic peptide
RASQSVRGNYLA

SEQ ID NO: 1216 - protein, 7 aa, Artificial Sequence
  Synthetic peptide
GASSRAT

SEQ ID NO: 1217 - protein, 9 aa, Artificial Sequence
  Synthetic peptide
QQYGYSPFT

SEQ ID NO: 1218 - protein, 120 aa, Artificial Sequence
  Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSS

SEQ ID NO: 1219 - protein, 108 aa, Artificial Sequence; identical to SEQ ID NO: 973
  Synthetic peptide

SEQ ID NO: 1220 - protein, 243 aa, Artificial Sequence
  Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIK

SEQ ID NO: 1221 - protein, 498 aa, Artificial Sequence
  Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1222 - protein, 120 aa, Artificial Sequence
  Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSS

SEQ ID NO: 1223 - protein, 108 aa, Artificial Sequence; identical to SEQ ID NO: 969
  Synthetic peptide

SEQ ID NO: 1224 - protein, 243 aa, Artificial Sequence
  Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIK

SEQ ID NO: 1225 - protein, 498 aa, Artificial Sequence
  Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1226 - protein, 5 aa, Artificial Sequence
  Synthetic peptide
TYAMS

SEQ ID NO: 1227 - protein, 17 aa, Artificial Sequence
  Synthetic peptide
AISGSGGGTFYAESVKG

SEQ ID NO: 1228 - protein, 11 aa, Artificial Sequence
  Synthetic peptide
HDYSNYPYFDY

SEQ ID NO: 1229 - protein, 12 aa, Artificial Sequence
  Synthetic peptide
RASQSIRSNYLA

SEQ ID NO: 1230 - protein, 7 aa, Artificial Sequence
  Synthetic peptide
GASSRAT

SEQ ID NO: 1231 - protein, 9 aa, Artificial Sequence
  Synthetic peptide
QQYGSSPFT

SEQ ID NO: 1232 - protein, 120 aa, Artificial Sequence
  Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSS

SEQ ID NO: 1233 - protein, 108 aa, Artificial Sequence; identical to SEQ ID NO: 977
  Synthetic peptide

SEQ ID NO: 1234 - protein, 243 aa, Artificial Sequence
  Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIK

SEQ ID NO: 1235 - protein, 498 aa, Artificial Sequence
  Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1236 - protein, 120 aa, Artificial Sequence
  Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSS

SEQ ID NO: 1237 - protein, 108 aa, Artificial Sequence; identical to SEQ ID NO: 268
  Synthetic peptide

SEQ ID NO: 1238 - protein, 243 aa, Artificial Sequence
  Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIK

SEQ ID NO: 1239 - protein, 498 aa, Artificial Sequence
  Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1240 - protein, 5 aa, Artificial Sequence
  Synthetic peptide
TYAMS

SEQ ID NO: 1241 - protein, 17 aa, Artificial Sequence
  Synthetic peptide
LISGSGGRTYYAESVKG

SEQ ID NO: 1242 - protein, 11 aa, Artificial Sequence
  Synthetic peptide
HDYSNYPYFDY

SEQ ID NO: 1243 - protein, 12 aa, Artificial Sequence
  Synthetic peptide
RASQSVRSNYLA

SEQ ID NO: 1244 - protein, 7 aa, Artificial Sequence
  Synthetic peptide
GASNRAT

SEQ ID NO: 1245 - protein, 9 aa, Artificial Sequence
  Synthetic peptide
QQYGISPPT

SEQ ID NO: 1246 - protein, 120 aa, Artificial Sequence
  Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSS

SEQ ID NO: 1247 - protein, 108 aa, Artificial Sequence; identical to SEQ ID NO: 981
  Synthetic peptide

SEQ ID NO: 1248 - protein, 243 aa, Artificial Sequence
  Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIK

SEQ ID NO: 1249 - protein, 498 aa, Artificial Sequence
  Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1250 - protein, 120 aa, Artificial Sequence
  Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSS

SEQ ID NO: 1251 - protein, 108 aa, Artificial Sequence; identical to SEQ ID NO: 278
  Synthetic peptide

SEQ ID NO: 1252 - protein, 243 aa, Artificial Sequence
  Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIK

SEQ ID NO: 1253 - protein, 498 aa, Artificial Sequence
  Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1254 - protein, 5 aa, Artificial Sequence
  Synthetic peptide
SYAMS

SEQ ID NO: 1255 - protein, 17 aa, Artificial Sequence
  Synthetic peptide
AISGSGGRAQYAESVQG

SEQ ID NO: 1256 - protein, 11 aa, Artificial Sequence
  Synthetic peptide
HDYSNYPYFDY

SEQ ID NO: 1257 - protein, 11 aa, Artificial Sequence
  Synthetic peptide
RASQSVSSNLA

SEQ ID NO: 1258 - protein, 7 aa, Artificial Sequence
  Synthetic peptide
GSSSRAT

SEQ ID NO: 1259 - protein, 9 aa, Artificial Sequence
  Synthetic peptide
QQYGSSPPP

SEQ ID NO: 1260 - protein, 120 aa, Artificial Sequence
  Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSS

SEQ ID NO: 1261 - protein, 107 aa, Artificial Sequence; identical to SEQ ID NO: 985
  Synthetic peptide

SEQ ID NO: 1262 - protein, 242 aa, Artificial Sequence
  Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIK

SEQ ID NO: 1263 - protein, 497 aa, Artificial Sequence
  Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1264 - protein, 120 aa, Artificial Sequence
  Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSS

SEQ ID NO: 1265 - protein, 107 aa, Artificial Sequence; identical to SEQ ID NO: 308
  Synthetic peptide

SEQ ID NO: 1266 - protein, 242 aa, Artificial Sequence
  Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIK

SEQ ID NO: 1267 - protein, 497 aa, Artificial Sequence
  Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1268 - protein, 5 aa, Artificial Sequence
  Synthetic peptide
SYAMS

SEQ ID NO: 1269 - protein, 17 aa, Artificial Sequence
  Synthetic peptide
AISGSGGRTFYAESVEG

SEQ ID NO: 1270 - protein, 11 aa, Artificial Sequence
  Synthetic peptide
HDYSNYPYFDY

SEQ ID NO: 1271 - protein, 12 aa, Artificial Sequence
  Synthetic peptide
RASQGVRSDYLA

SEQ ID NO: 1272 - protein, 7 aa, Artificial Sequence
  Synthetic peptide
GASSRAT

SEQ ID NO: 1273 - protein, 9 aa, Artificial Sequence
  Synthetic peptide
QQYGSTPPT

SEQ ID NO: 1274 - protein, 120 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSS

SEQ ID NO: 1275 - protein, 108 aa, Artificial Sequence; identical to SEQ ID NO: 989
  Synthetic peptide

SEQ ID NO: 1276 - protein, 243 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIK

SEQ ID NO: 1277 - protein, 498 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1278 - protein, 120 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSS

SEQ ID NO: 1279 - protein, 108 aa, Artificial Sequence; identical to SEQ ID NO: 318
  Synthetic peptide

SEQ ID NO: 1280 - protein, 243 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIK

SEQ ID NO: 1281 - protein, 498 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1282 - protein, 5 aa, Artificial Sequence
  Synthetic peptide
SYAMS

SEQ ID NO: 1283 - protein, 17 aa, Artificial Sequence
  Synthetic peptide
AIGEGGGYTYYAESVKG

SEQ ID NO: 1284 - protein, 11 aa, Artificial Sequence
  Synthetic peptide
HDYSNYPYFDY

SEQ ID NO: 1285 - protein, 12 aa, Artificial Sequence
  Synthetic peptide
RASQGVRSSYFA

SEQ ID NO: 1286 - protein, 7 aa, Artificial Sequence
  Synthetic peptide
GASTRAT

SEQ ID NO: 1287 - protein, 9 aa, Artificial Sequence
  Synthetic peptide
QQYGSSPPT

SEQ ID NO: 1288 - protein, 119 aa, Artificial Sequence
  Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVS

SEQ ID NO: 1289 - protein, 108 aa, Artificial Sequence; identical to SEQ ID NO: 993
  Synthetic peptide

SEQ ID NO: 1290 - protein, 243 aa, Artificial Sequence
  Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIK

SEQ ID NO: 1291 - protein, 498 aa, Artificial Sequence
  Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1292 - protein, 120 aa, Artificial Sequence
  Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSS

SEQ ID NO: 1293 - protein, 108 aa, Artificial Sequence; identical to SEQ ID NO: 368
  Synthetic peptide

SEQ ID NO: 1294 - protein, 243 aa, Artificial Sequence
  Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIK

SEQ ID NO: 1295 - protein, 498 aa, Artificial Sequence
  Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1296 - protein, 5 aa, Artificial Sequence
  Synthetic peptide
SYAMS

SEQ ID NO: 1297 - protein, 17 aa, Artificial Sequence
  Synthetic peptide
AISGSGGRTFYAESVEG

SEQ ID NO: 1298 - protein, 11 aa, Artificial Sequence
  Synthetic peptide
HDYSNYPYFDY

SEQ ID NO: 1299 - protein, 12 aa, Artificial Sequence
  Synthetic peptide
RASQSIRSNYLA

SEQ ID NO: 1300 - protein, 7 aa, Artificial Sequence
  Synthetic peptide
GASSRAT

SEQ ID NO: 1301 - protein, 9 aa, Artificial Sequence
  Synthetic peptide
QQYGSSPPS

SEQ ID NO: 1302 - protein, 120 aa, Artificial Sequence
  Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSS

SEQ ID NO: 1303 - protein, 108 aa, Artificial Sequence; identical to SEQ ID NO: 997
  Synthetic peptide

SEQ ID NO: 1304 - protein, 243 aa, Artificial Sequence
  Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIK

SEQ ID NO: 1305 - protein, 498 aa, Artificial Sequence
  Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1306 - protein, 120 aa, Artificial Sequence
  Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSS

SEQ ID NO: 1307 - protein, 108 aa, Artificial Sequence; identical to SEQ ID NO: 378
  Synthetic peptide

SEQ ID NO: 1308 - protein, 243 aa, Artificial Sequence
  Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIK

SEQ ID NO: 1309 - protein, 498 aa, Artificial Sequence
  Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1310 - protein, 5 aa, Artificial Sequence
  Synthetic peptide
SYAMS

SEQ ID NO: 1311 - protein, 17 aa, Artificial Sequence
  Synthetic peptide
AISGSGGGTFYAESVEG

SEQ ID NO: 1312 - protein, 11 aa, Artificial Sequence
  Synthetic peptide
HDYSNYPYFDY

SEQ ID NO: 1313 - protein, 12 aa, Artificial Sequence
  Synthetic peptide
RASQSVRSSYLA

SEQ ID NO: 1314 - protein, 7 aa, Artificial Sequence
  Synthetic peptide
GASSRAT

SEQ ID NO: 1315 - protein, 9 aa, Artificial Sequence
  Synthetic peptide
QQYGDLPFT

SEQ ID NO: 1316 - protein, 120 aa, Artificial Sequence
  Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSS

SEQ ID NO: 1317 - protein, 108 aa, Artificial Sequence; identical to SEQ ID NO: 1001
  Synthetic peptide

SEQ ID NO: 1318 - protein, 243 aa, Artificial Sequence
  Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIK

SEQ ID NO: 1319 - protein, 498 aa, Artificial Sequence
  Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1320 - protein, 120 aa, Artificial Sequence
  Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSS

SEQ ID NO: 1321 - protein, 108 aa, Artificial Sequence; identical to SEQ ID NO: 388
  Synthetic peptide

SEQ ID NO: 1322 - protein, 243 aa, Artificial Sequence
  Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIK

SEQ ID NO: 1323 - protein, 498 aa, Artificial Sequence
  Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1324 - protein, 5 aa, Artificial Sequence
  Synthetic peptide
SYAMS

SEQ ID NO: 1325 - protein, 17 aa, Artificial Sequence
  Synthetic peptide
AISGSGGRTFYAESVEG

SEQ ID NO: 1326 - protein, 11 aa, Artificial Sequence
  Synthetic peptide
HDYSNYPYFDY

SEQ ID NO: 1327 - protein, 12 aa, Artificial Sequence
  Synthetic peptide
RASQSVRSSYLA

SEQ ID NO: 1328 - protein, 7 aa, Artificial Sequence
  Synthetic peptide
GASSRAT

SEQ ID NO: 1329 - protein, 9 aa, Artificial Sequence
  Synthetic peptide
QQYGDLPFT

SEQ ID NO: 1330 - protein, 120 aa, Artificial Sequence; identical to SEQ ID NO: 1274
  Synthetic peptide

SEQ ID NO: 1331 - protein, 108 aa, Artificial Sequence; identical to SEQ ID NO: 1005
  Synthetic peptide

SEQ ID NO: 1332 - protein, 243 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIK

SEQ ID NO: 1333 - protein, 498 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1334 - protein, 120 aa, Artificial Sequence; identical to SEQ ID NO: 1278
  Synthetic peptide

SEQ ID NO: 1335 - protein, 108 aa, Artificial Sequence; identical to SEQ ID NO: 408
  Synthetic peptide

SEQ ID NO: 1336 - protein, 243 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIK

SEQ ID NO: 1337 - protein, 498 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1338 - protein, 5 aa, Artificial Sequence
  Synthetic peptide
TYAMS

SEQ ID NO: 1339 - protein, 17 aa, Artificial Sequence
  Synthetic peptide
LISGSGGRTYYAESVKG

SEQ ID NO: 1340 - protein, 11 aa, Artificial Sequence
  Synthetic peptide
HDYSNYPYFDY

SEQ ID NO: 1341 - protein, 12 aa, Artificial Sequence
  Synthetic peptide
RASQGVRSSYLA

SEQ ID NO: 1342 - protein, 7 aa, Artificial Sequence
  Synthetic peptide
GASSRAT

SEQ ID NO: 1343 - protein, 9 aa, Artificial Sequence
  Synthetic peptide
QQYGSSPPT

SEQ ID NO: 1344 - protein, 120 aa, Artificial Sequence; identical to SEQ ID NO: 1246
  Synthetic peptide

SEQ ID NO: 1345 - protein, 108 aa, Artificial Sequence; identical to SEQ ID NO: 1009
  Synthetic peptide

SEQ ID NO: 1346 - protein, 243 aa, Artificial Sequence
  Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIK

SEQ ID NO: 1347 - protein, 498 aa, Artificial Sequence
  Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1348 - protein, 120 aa, Artificial Sequence; identical to SEQ ID NO: 1250
  Synthetic peptide

SEQ ID NO: 1349 - protein, 108 aa, Artificial Sequence; identical to SEQ ID NO: 418
  Synthetic peptide

SEQ ID NO: 1350 - protein, 243 aa, Artificial Sequence
  Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIK

SEQ ID NO: 1351 - protein, 498 aa, Artificial Sequence
  Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1352 - protein, 5 aa, Artificial Sequence
  Synthetic peptide
SYAMS

SEQ ID NO: 1353 - protein, 17 aa, Artificial Sequence
  Synthetic peptide
AISGSGGRTFYAESVEG

SEQ ID NO: 1354 - protein, 11 aa, Artificial Sequence
  Synthetic peptide
HDYSNYPYFDY

SEQ ID NO: 1355 - protein, 12 aa, Artificial Sequence
  Synthetic peptide
RASQSVRSNYLA

SEQ ID NO: 1356 - protein, 7 aa, Artificial Sequence
  Synthetic peptide
GASSRAT

SEQ ID NO: 1357 - protein, 9 aa, Artificial Sequence
  Synthetic peptide
QQYGSSPPT

SEQ ID NO: 1358 - protein, 120 aa, Artificial Sequence; identical to SEQ ID NO: 1302
  Synthetic peptide

SEQ ID NO: 1359 - protein, 108 aa, Artificial Sequence; identical to SEQ ID NO: 1013
  Synthetic peptide

SEQ ID NO: 1360 - protein, 243 aa, Artificial Sequence
  Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIK

SEQ ID NO: 1361 - protein, 498 aa, Artificial Sequence
  Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1362 - protein, 120 aa, Artificial Sequence; identical to SEQ ID NO: 1306
  Synthetic peptide

SEQ ID NO: 1363 - protein, 108 aa, Artificial Sequence; identical to SEQ ID NO: 428
  Synthetic peptide

SEQ ID NO: 1364 - protein, 243 aa, Artificial Sequence
  Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIK

SEQ ID NO: 1365 - protein, 498 aa, Artificial Sequence
  Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1366 - protein, 5 aa, Artificial Sequence
  Synthetic peptide
SYAMS

SEQ ID NO: 1367 - protein, 17 aa, Artificial Sequence
  Synthetic peptide
VISGSGGITDFAESVKG

SEQ ID NO: 1368 - protein, 11 aa, Artificial Sequence
  Synthetic peptide
HDYSNYFFFDY

SEQ ID NO: 1369 - protein, 11 aa, Artificial Sequence
  Synthetic peptide
RASQGISNYLA

SEQ ID NO: 1370 - protein, 7 aa, Artificial Sequence
  Synthetic peptide
AASILQS

SEQ ID NO: 1371 - protein, 9 aa, Artificial Sequence
  Synthetic peptide
QQYFAYPIT

SEQ ID NO: 1372 - protein, 120 aa, Artificial Sequence
  Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSS

SEQ ID NO: 1373 - protein, 107 aa, Artificial Sequence; identical to SEQ ID NO: 678
  Synthetic peptide

SEQ ID NO: 1374 - protein, 242 aa, Artificial Sequence
  Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIK

SEQ ID NO: 1375 - protein, 497 aa, Artificial Sequence
  Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1376 - protein, 120 aa, Artificial Sequence
  Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSS

SEQ ID NO: 1377 - protein, 107 aa, Artificial Sequence; identical to SEQ ID NO: 478
  Synthetic peptide

SEQ ID NO: 1378 - protein, 242 aa, Artificial Sequence
  Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIK

SEQ ID NO: 1379 - protein, 497 aa, Artificial Sequence
  Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1380 - protein, 5 aa, Artificial Sequence
  Synthetic peptide
SYAMS

SEQ ID NO: 1381 - protein, 17 aa, Artificial Sequence
  Synthetic peptide
AISGSGGRTFYAESVEG

SEQ ID NO: 1382 - protein, 11 aa, Artificial Sequence
  Synthetic peptide
HDYSNYPYFDY

SEQ ID NO: 1383 - protein, 12 aa, Artificial Sequence
  Synthetic peptide
RASQSVRSSYLA

SEQ ID NO: 1384 - protein, 7 aa, Artificial Sequence
  Synthetic peptide
GASSRAT

SEQ ID NO: 1385 - protein, 9 aa, Artificial Sequence
  Synthetic peptide
QQYGSSPPT

SEQ ID NO: 1386 - protein, 120 aa, Artificial Sequence; identical to SEQ ID NO: 1092
  Synthetic peptide

SEQ ID NO: 1387 - protein, 108 aa, Artificial Sequence; identical to SEQ ID NO: 1021
  Synthetic peptide

SEQ ID NO: 1388 - protein, 243 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIK

SEQ ID NO: 1389 - protein, 498 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1390 - protein, 120 aa, Artificial Sequence; identical to SEQ ID NO: 1096
  Synthetic peptide

SEQ ID NO: 1391 - protein, 108 aa, Artificial Sequence; identical to SEQ ID NO: 528
  Synthetic peptide

SEQ ID NO: 1392 - protein, 243 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIK

SEQ ID NO: 1393 - protein, 498 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1394 - protein, 5 aa, Artificial Sequence
  Synthetic peptide
IYAMS

SEQ ID NO: 1395 - protein, 17 aa, Artificial Sequence
  Synthetic peptide
AIGGSGGSTFYAESVKG

SEQ ID NO: 1396 - protein, 11 aa, Artificial Sequence
  Synthetic peptide
HDYSNYPYFDY

SEQ ID NO: 1397 - protein, 12 aa, Artificial Sequence
  Synthetic peptide
RASQSVRSSYVA

SEQ ID NO: 1398 - protein, 7 aa, Artificial Sequence
  Synthetic peptide
GASSRAT

SEQ ID NO: 1399 - protein, 9 aa, Artificial Sequence
  Synthetic peptide
QQYGDLPFT

SEQ ID NO: 1400 - protein, 120 aa, Artificial Sequence
  Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSS

SEQ ID NO: 1401 - protein, 108 aa, Artificial Sequence; identical to SEQ ID NO: 1025
  Synthetic peptide

SEQ ID NO: 1402 - protein, 243 aa, Artificial Sequence
  Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIK

SEQ ID NO: 1403 - protein, 498 aa, Artificial Sequence
  Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1404 - protein, 120 aa, Artificial Sequence
  Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSS

SEQ ID NO: 1405 - protein, 108 aa, Artificial Sequence; identical to SEQ ID NO: 538
  Synthetic peptide

SEQ ID NO: 1406 - protein, 243 aa, Artificial Sequence
  Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIK

SEQ ID NO: 1407 - protein, 498 aa, Artificial Sequence
  Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1408 - protein, 7 aa, Artificial Sequence
  Synthetic peptide
SSSYYWG

SEQ ID NO: 1409 - protein, 16 aa, Artificial Sequence
  Synthetic peptide
SIYHSGGTYFNPSLKS

SEQ ID NO: 1410 - protein, 15 aa, Artificial Sequence
  Synthetic peptide
HYEILTGYYPDVFDI

SEQ ID NO: 1411 - protein, 11 aa, Artificial Sequence
  Synthetic peptide
RASQSISSYLN

SEQ ID NO: 1412 - protein, 7 aa, Artificial Sequence
  Synthetic peptide
AASNLQS

SEQ ID NO: 1413 - protein, 9 aa, Artificial Sequence
  Synthetic peptide
QQSFSSPRT

SEQ ID NO: 1414 - protein, 125 aa, Artificial Sequence; identical to SEQ ID NO: 1028
  Synthetic peptide

SEQ ID NO: 1415 - protein, 107 aa, Artificial Sequence; identical to SEQ ID NO: 1029
  Synthetic peptide

SEQ ID NO: 1416 - protein, 247 aa, Artificial Sequence; identical to SEQ ID NO: 1030
  Synthetic peptide

SEQ ID NO: 1417 - protein, 502 aa, Artificial Sequence; identical to SEQ ID NO: 1031
  Synthetic peptide

SEQ ID NO: 1418 - protein, 125 aa, Artificial Sequence; identical to SEQ ID NO: 577
  Synthetic peptide

SEQ ID NO: 1419 - protein, 107 aa, Artificial Sequence; identical to SEQ ID NO: 578
  Synthetic peptide

SEQ ID NO: 1420 - protein, 247 aa, Artificial Sequence; identical to SEQ ID NO: 579
  Synthetic peptide

SEQ ID NO: 1421 - protein, 502 aa, Artificial Sequence [sequence omitted]

SEQ ID NO: 1422 - protein, 5 aa, Artificial Sequence
  Synthetic peptide
SYSMN

SEQ ID NO: 1423 - protein, 17 aa, Artificial Sequence
  Synthetic peptide
YISSSGGYIYYAESVKG

SEQ ID NO: 1424 - protein, 11 aa, Artificial Sequence
  Synthetic peptide
GDYSNYAYFDY

SEQ ID NO: 1425 - protein, 11 aa, Artificial Sequence
  Synthetic peptide
RASQGISNYLA

SEQ ID NO: 1426 - protein, 7 aa, Artificial Sequence
  Synthetic peptide
AASTLQS

SEQ ID NO: 1427 - protein, 9 aa, Artificial Sequence
  Synthetic peptide
QQYYSTPLT

SEQ ID NO: 1428 - protein, 120 aa, Artificial Sequence
  Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSS

SEQ ID NO: 1429 - protein, 107 aa, Artificial Sequence; identical to SEQ ID NO: 728
  Synthetic peptide

SEQ ID NO: 1430 - protein, 242 aa, Artificial Sequence
  Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIK

SEQ ID NO: 1431 - protein, 497 aa, Artificial Sequence
  Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1432 - protein, 120 aa, Artificial Sequence
  Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSS

SEQ ID NO: 1433 - protein, 107 aa, Artificial Sequence; identical to SEQ ID NO: 618
  Synthetic peptide

SEQ ID NO: 1434 - protein, 242 aa, Artificial Sequence
  Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIK

SEQ ID NO: 1435 - protein, 497 aa, Artificial Sequence
  Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1436 - protein, 5 aa, Artificial Sequence
  Synthetic peptide
VYAMS

SEQ ID NO: 1437 - protein, 17 aa, Artificial Sequence
  Synthetic peptide
TISGSGGSTFYAESVKG

SEQ ID NO: 1438 - protein, 11 aa, Artificial Sequence
  Synthetic peptide
HDYSNYAYFDY

SEQ ID NO: 1439 - protein, 12 aa, Artificial Sequence
  Synthetic peptide
RASQSVRSSYLA

SEQ ID NO: 1440 - protein, 7 aa, Artificial Sequence
  Synthetic peptide
GASSRAT

SEQ ID NO: 1441 - protein, 9 aa, Artificial Sequence
  Synthetic peptide
QQYGDLPFT

SEQ ID NO: 1442 - protein, 120 aa, Artificial Sequence
  Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSS

SEQ ID NO: 1443 - protein, 108 aa, Artificial Sequence; identical to SEQ ID NO: 638
  Synthetic peptide

SEQ ID NO: 1444 - protein, 243 aa, Artificial Sequence
  Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 1445 - protein, 498 aa, Artificial Sequence
  Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1446 - protein, 120 aa, Artificial Sequence
  Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSS

SEQ ID NO: 1447 - protein, 108 aa, Artificial Sequence; identical to SEQ ID NO: 228
  Synthetic peptide

SEQ ID NO: 1448 - protein, 243 aa, Artificial Sequence
  Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 1449 - protein, 498 aa, Artificial Sequence
  Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1450 - protein, 5 aa, Artificial Sequence
  Synthetic peptide
SYGMH

SEQ ID NO: 1451 - protein, 17 aa, Artificial Sequence
  Synthetic peptide
VISYEGSNKYYAESVKG

SEQ ID NO: 1452 - protein, 15 aa, Artificial Sequence
  Synthetic peptide
GRYYGSGNYNHGMDV

SEQ ID NO: 1453 - protein, 11 aa, Artificial Sequence
  Synthetic peptide
RASQSISSYLN

SEQ ID NO: 1454 - protein, 7 aa, Artificial Sequence
  Synthetic peptide
AASSLQS

SEQ ID NO: 1455 - protein, 9 aa, Artificial Sequence
  Synthetic peptide
QQSYSTPFT

SEQ ID NO: 1456 - protein, 124 aa, Artificial Sequence
  Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSS

SEQ ID NO: 1457 - protein, 107 aa, Artificial Sequence; identical to SEQ ID NO: 698
  Synthetic peptide

SEQ ID NO: 1458 - protein, 246 aa, Artificial Sequence
  Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIK

SEQ ID NO: 1459 - protein, 501 aa, Artificial Sequence
  Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1460 - protein, 124 aa, Artificial Sequence
  Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSS

SEQ ID NO: 1461 - protein, 107 aa, Artificial Sequence; identical to SEQ ID NO: 548
  Synthetic peptide

SEQ ID NO: 1462 - protein, 246 aa, Artificial Sequence
  Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIK

SEQ ID NO: 1463 - protein, 501 aa, Artificial Sequence
  Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1464 - protein, 5 aa, Artificial Sequence
  Synthetic peptide
SYGMH

SEQ ID NO: 1465 - protein, 17 aa, Artificial Sequence
  Synthetic peptide
VTWYDASNKYYGDAVKG

SEQ ID NO: 1466 - protein, 13 aa, Artificial Sequence
  Synthetic peptide
DLLRGVKGYAMDV

SEQ ID NO: 1467 - protein, 12 aa, Artificial Sequence
  Synthetic peptide
RASQSLRRIYLA

SEQ ID NO: 1468 - protein, 7 aa, Artificial Sequence
  Synthetic peptide
DVFDRAT

SEQ ID NO: 1469 - protein, 9 aa, Artificial Sequence
  Synthetic peptide
QQYSESPFT

SEQ ID NO: 1470 - protein, 122 aa, Artificial Sequence
  Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSS

SEQ ID NO: 1471 - protein, 108 aa, Artificial Sequence
  Synthetic peptide
EIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIK

SEQ ID NO: 1472 - protein, 245 aa, Artificial Sequence
  Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIK

SEQ ID NO: 1473 - protein, 500 aa, Artificial Sequence
  Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1474 - protein, 122 aa, Artificial Sequence
  Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSS

SEQ ID NO: 1475 - protein, 108 aa, Artificial Sequence
  Synthetic peptide
EIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIK

SEQ ID NO: 1476 - protein, 245 aa, Artificial Sequence
  Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIK

SEQ ID NO: 1477 - protein, 500 aa, Artificial Sequence
  Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1478 - protein, 5 aa, Artificial Sequence
  Synthetic peptide
SYGIS

SEQ ID NO: 1479 - protein, 17 aa, Artificial Sequence
  Synthetic peptide
WISAYQGYTHYAQKLQG

SEQ ID NO: 1480 - protein, 12 aa, Artificial Sequence
  Synthetic peptide
DYGGNDYYGMDV

SEQ ID NO: 1481 - protein, 13 aa, Artificial Sequence
  Synthetic peptide
SGSSSNIGINYVY

SEQ ID NO: 1482 - protein, 7 aa, Artificial Sequence
  Synthetic peptide
RSDQRPS

SEQ ID NO: 1483 - protein, 11 aa, Artificial Sequence
  Synthetic peptide
AAFDESLSGVV

SEQ ID NO: 1484 - protein, 121 aa, Artificial Sequence
  Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSS

SEQ ID NO: 1485 - protein, 110 aa, Artificial Sequence
  Synthetic peptide
QSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVL

SEQ ID NO: 1486 - protein, 246 aa, Artificial Sequence
  Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVL

SEQ ID NO: 1487 - protein, 501 aa, Artificial Sequence
  Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1488 - protein, 121 aa, Artificial Sequence
  Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSS

SEQ ID NO: 1489 - protein, 110 aa, Artificial Sequence
  Synthetic peptide
QSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVL

SEQ ID NO: 1490 - protein, 246 aa, Artificial Sequence
  Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVL

SEQ ID NO: 1491 - protein, 501 aa, Artificial Sequence
  Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1492 - protein, 5 aa, Artificial Sequence
  Synthetic peptide
YYGMH

SEQ ID NO: 1493 - protein, 17 aa, Artificial Sequence
  Synthetic peptide
VIWYDASNKYYADAVKG

SEQ ID NO: 1494 - protein, 12 aa, Artificial Sequence
  Synthetic peptide
DREMGSRGDFDY

SEQ ID NO: 1495 - protein, 11 aa, Artificial Sequence
  Synthetic peptide
RASQGINNYLA

SEQ ID NO: 1496 - protein, 7 aa, Artificial Sequence
  Synthetic peptide
AVSILQS

SEQ ID NO: 1497 - protein, 9 aa, Artificial Sequence
  Synthetic peptide
QQYNFYPFS

SEQ ID NO: 1498 - protein, 121 aa, Artificial Sequence
  Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSS

SEQ ID NO: 1499 - protein, 107 aa, Artificial Sequence
  Synthetic peptide
DIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIK

SEQ ID NO: 1500 - protein, 243 aa, Artificial Sequence
  Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIK

SEQ ID NO: 1501 - protein, 498 aa, Artificial Sequence
  Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1502 - protein, 121 aa, Artificial Sequence
  Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSS

SEQ ID NO: 1503 - protein, 107 aa, Artificial Sequence
  Synthetic peptide
DIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIK

SEQ ID NO: 1504 - protein, 243 aa, Artificial Sequence
  Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIK

SEQ ID NO: 1505 - protein, 498 aa, Artificial Sequence
  Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1506 - protein, 5 aa, Artificial Sequence
  Synthetic peptide
GFYWS

SEQ ID NO: 1507 - protein, 16 aa, Artificial Sequence
  Synthetic peptide
EIYHSGHATNNPSLKS

SEQ ID NO: 1508 - protein, 10 aa, Artificial Sequence
  Synthetic peptide
GGNSGYIFDY

SEQ ID NO: 1509 - protein, 11 aa, Artificial Sequence
  Synthetic peptide
RTSQYIGRYLN

SEQ ID NO: 1510 - protein, 7 aa, Artificial Sequence
  Synthetic peptide
GASTLQQ

SEQ ID NO: 1511 - protein, 9 aa, Artificial Sequence
  Synthetic peptide
QQTYSTPRT

SEQ ID NO: 1512 - protein, 118 aa, Artificial Sequence
  Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSS

SEQ ID NO: 1513 - protein, 107 aa, Artificial Sequence
  Synthetic peptide
DVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIK

SEQ ID NO: 1514 - protein, 240 aa, Artificial Sequence
  Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIK

SEQ ID NO: 1515 - protein, 495 aa, Artificial Sequence
  Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1516 - protein, 118 aa, Artificial Sequence
  Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSS

SEQ ID NO: 1517 - protein, 107 aa, Artificial Sequence
  Synthetic peptide
DVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIK

SEQ ID NO: 1518 - protein, 240 aa, Artificial Sequence
  Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIK

SEQ ID NO: 1519 - protein, 495 aa, Artificial Sequence
  Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1520 - protein, 5 aa, Artificial Sequence
  Synthetic peptide
TYGMH

SEQ ID NO: 1521 - protein, 17 aa, Artificial Sequence
  Synthetic peptide
VIWYEGSNKYYGESVKG

SEQ ID NO: 1522 - protein, 11 aa, Artificial Sequence
  Synthetic peptide
DNSHYYYGMDV

SEQ ID NO: 1523 - protein, 14 aa, Artificial Sequence
  Synthetic peptide
TGSSSNIGAGYDVN

SEQ ID NO: 1524 - protein, 7 aa, Artificial Sequence
  Synthetic peptide
VNNNRPS

SEQ ID NO: 1525 - protein, 11 aa, Artificial Sequence
  Synthetic peptide
QSYDTSLSASV

SEQ ID NO: 1526 - protein, 120 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSS

SEQ ID NO: 1527 - protein, 111 aa, Artificial Sequence
  Synthetic peptide
QSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVL

SEQ ID NO: 1528 - protein, 246 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVL

SEQ ID NO: 1529 - protein, 501 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1530 - protein, 120 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSS

SEQ ID NO: 1531 - protein, 111 aa, Artificial Sequence; identical to SEQ ID NO: 8
  Synthetic peptide

SEQ ID NO: 1532 - protein, 246 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVL

SEQ ID NO: 1533 - protein, 501 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1534 - protein, 5 aa, Artificial Sequence
  Synthetic peptide
TYGMH

SEQ ID NO: 1535 - protein, 17 aa, Artificial Sequence
  Synthetic peptide
VIWYEGSNKYYGESVKG

SEQ ID NO: 1536 - protein, 11 aa, Artificial Sequence
  Synthetic peptide
DNSHYYYGMDV

SEQ ID NO: 1537 - protein, 14 aa, Artificial Sequence
  Synthetic peptide
TGSSSNIGAGYDVN

SEQ ID NO: 1538 - protein, 7 aa, Artificial Sequence
  Synthetic peptide
VNNNRPS

SEQ ID NO: 1539 - protein, 11 aa, Artificial Sequence
  Synthetic peptide
QSYETSLSASV

SEQ ID NO: 1540 - protein, 120 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSS

SEQ ID NO: 1541 - protein, 111 aa, Artificial Sequence
  Synthetic peptide
QSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVL

SEQ ID NO: 1542 - protein, 246 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVL

SEQ ID NO: 1543 - protein, 501 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1544 - protein, 120 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSS

SEQ ID NO: 1545 - protein, 111 aa, Artificial Sequence
  Synthetic peptide
QSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVL

SEQ ID NO: 1546 - protein, 246 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVL

SEQ ID NO: 1547 - protein, 501 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1548 - protein, 7 aa, Artificial Sequence
  Synthetic peptide
SGVYYWS

SEQ ID NO: 1549 - protein, 16 aa, Artificial Sequence
  Synthetic peptide
YIYYSGSTSYNPSLKS

SEQ ID NO: 1550 - protein, 10 aa, Artificial Sequence
  Synthetic peptide
SGYSYALFDY

SEQ ID NO: 1551 - protein, 11 aa, Artificial Sequence
  Synthetic peptide
RASQSVDRYFN

SEQ ID NO: 1552 - protein, 7 aa, Artificial Sequence
  Synthetic peptide
AASSLQS

SEQ ID NO: 1553 - protein, 9 aa, Artificial Sequence
  Synthetic peptide
QQSYSTPWT

SEQ ID NO: 1554 - protein, 120 aa, Artificial Sequence
  Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSS

SEQ ID NO: 1555 - protein, 107 aa, Artificial Sequence
  Synthetic peptide
DIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVK

SEQ ID NO: 1556 - protein, 242 aa, Artificial Sequence
  Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVK

SEQ ID NO: 1557 - protein, 497 aa, Artificial Sequence
  Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1558 - protein, 120 aa, Artificial Sequence
  Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSS

SEQ ID NO: 1559 - protein, 107 aa, Artificial Sequence
  Synthetic peptide
DIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVK

SEQ ID NO: 1560 - protein, 242 aa, Artificial Sequence
  Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVK

SEQ ID NO: 1561 - protein, 497 aa, Artificial Sequence
  Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1562 - protein, 7 aa, Artificial Sequence
  Synthetic peptide
SGGYYWS

SEQ ID NO: 1563 - protein, 16 aa, Artificial Sequence
  Synthetic peptide
YIFYSGSTDYNPSLKS

SEQ ID NO: 1564 - protein, 10 aa, Artificial Sequence
  Synthetic peptide
SGYSYALFDA

SEQ ID NO: 1565 - protein, 11 aa, Artificial Sequence
  Synthetic peptide
RASQFIGRYFN

SEQ ID NO: 1566 - protein, 7 aa, Artificial Sequence
  Synthetic peptide
AESSLQS

SEQ ID NO: 1567 - protein, 9 aa, Artificial Sequence
  Synthetic peptide
QQSYSTPWT

SEQ ID NO: 1568 - protein, 120 aa, Artificial Sequence
  Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSS

SEQ ID NO: 1569 - protein, 107 aa, Artificial Sequence
  Synthetic peptide
DIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIK

SEQ ID NO: 1570 - protein, 242 aa, Artificial Sequence
  Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIK

SEQ ID NO: 1571 - protein, 497 aa, Artificial Sequence
  Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1572 - protein, 120 aa, Artificial Sequence
  Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSS

SEQ ID NO: 1573 - protein, 107 aa, Artificial Sequence
  Synthetic peptide
DIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIK

SEQ ID NO: 1574 - protein, 242 aa, Artificial Sequence
  Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIK

SEQ ID NO: 1575 - protein, 497 aa, Artificial Sequence
  Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1576 - protein, 986 aa, Artificial Sequence
  Synthetic peptide
EVQLLESGGGLVQPGGSLRLSCAASGFTFSSYAMSWVRQAPGKGLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1577 - protein, 986 aa, Artificial Sequence
  Synthetic peptide
EVQLLESGGGLVQPGGSLRLSCAASGFTFSSYAMSWVRQAPGKCLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1578 - protein, 986 aa, Artificial Sequence
  Synthetic peptide
EVQLLESGGGLVQPGGSLKLSCAASGFTFSIYAMSWVRQAPGKGLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1579 - protein, 986 aa, Artificial Sequence
  Synthetic peptide
EVQLLESGGGLVQPGGSLKLSCAASGFTFSIYAMSWVRQAPGKCLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1580 - protein, 986 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1581 - protein, 986 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1582 - protein, 986 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1583 - protein, 986 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1584 - protein, 986 aa, Artificial Sequence
  Synthetic peptide
EVQLLESGGGLVQSGGSLRLSCAASGFTFSSYAMSWVRQAPGKGLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1585 - protein, 986 aa, Artificial Sequence
  Synthetic peptide
EVQLLESGGGLVQSGGSLRLSCAASGFTFSSYAMSWVRQAPGKCLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1586 - protein, 986 aa, Artificial Sequence
  Synthetic peptide
EVQLLESGGGLVQPGGSLRLSCAASGFTFSSYAMSWVRQAPGKGLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1587 - protein, 986 aa, Artificial Sequence
  Synthetic peptide
EVQLLESGGGLVQPGGSLRLSCAASGFTFSSYAMSWVRQAPGKCLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1588 - protein, 986 aa, Artificial Sequence
  Synthetic peptide
EVQLLESGGGLVQPGGSLRLSCAASGFTFSTYAMSWVRQAPGKGLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1589 - protein, 986 aa, Artificial Sequence
  Synthetic peptide
EVQLLESGGGLVQPGGSLRLSCAASGFTFSTYAMSWVRQAPGKCLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1590 - protein, 986 aa, Artificial Sequence
  Synthetic peptide
EVQLLESGGGMVQPGGSLRLSCAASGFTFSTYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1591 - protein, 986 aa, Artificial Sequence
  Synthetic peptide
EVQLLESGGGMVQPGGSLRLSCAASGFTFSTYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1592 - protein, 986 aa, Artificial Sequence
  Synthetic peptide
EVQLLESGGGLVQPGGSLRLSCAASGFTFSSYAMSWVRQAPGKGLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1593 - protein, 986 aa, Artificial Sequence
  Synthetic peptide
EVQLLESGGGLVQPGGSLRLSCAASGFTFSSYAMSWVRQAPGKCLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1594 - protein, 986 aa, Artificial Sequence
  Synthetic peptide
EVQLLESGGGLAQPGGSLRLSCAASGFTFSSYAMSWVRQAPGKGLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1595 - protein, 986 aa, Artificial Sequence
  Synthetic peptide
EVQLLESGGGLAQPGGSLRLSCAASGFTFSSYAMSWVRQAPGKCLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1596 - protein, 986 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1597 - protein, 986 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1598 - protein, 986 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1599 - protein, 986 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1600 - protein, 986 aa, Artificial Sequence
  Synthetic peptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1601 - protein, 986 aa, Artificial Sequence
  Synthetic peptide
EVQLLESGGGLVQPGGSLRLSCAASGFTFSSYAMSWVRQAPGKCLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1602 - protein, 986 aa, Artificial Sequence
  Synthetic peptide
EVQLLESGGGLVQPGGSLRLSCAASGFTFSTYAMSWVRQAPGKGLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1603 - protein, 986 aa, Artificial Sequence
  Synthetic peptide
EVQLLESGGGLVQPGGSLRLSCAASGFTFSTYAMSWVRQAPGKCLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1604 - protein, 986 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1605 - protein, 986 aa, Artificial Sequence
  Synthetic peptide
EVQLLESGGGLVQPGGSLRLSCAASGFTFSTYAMSWVRQAPGKCLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1606 - protein, 985 aa, Artificial Sequence
  Synthetic peptide
EVQLLESGGGLVQPGGSLRLSCAASGFTFSSYAMSWVRQSPGKGLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1607 - protein, 985 aa, Artificial Sequence
  Synthetic peptide
EVQLLESGGGLVQPGGSLRLSCAASGFTFSSYAMSWVRQSPGKCLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1608 - protein, 986 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1609 - protein, 986 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1610 - protein, 986 aa, Artificial Sequence
  Synthetic peptide
EVQLLESGGGLVQPGGSLRLSCAASGFTFSSYAMSWVRQAPGKGLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1611 - protein, 986 aa, Artificial Sequence
  Synthetic peptide
EVQLLESGGGLVQPGGSLRLSCAASGFTFSSYAMSWVRQAPGKCLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1612 - protein, 986 aa, Artificial Sequence
  Synthetic peptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1613 - protein, 986 aa, Artificial Sequence
  Synthetic peptide
EVQLLESGGGVVQPGRSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1614 - protein, 986 aa, Artificial Sequence
  Synthetic peptide
EVQLLESGGGVVQPGRSLRLSCAASGFTFSSYAMSWVRQAPGKGLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1615 - protein, 986 aa, Artificial Sequence
  Synthetic peptide
EVQLLESGGGVVQPGRSLRLSCAASGFTFSSYAMSWVRQAPGKCLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1616 - protein, 986 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1617 - protein, 986 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1618 - protein, 986 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1619 - protein, 986 aa, Artificial Sequence
  Synthetic peptide
EVQLLESGGGLVQPGGSLRLSCAASGFTFSTYAMSWVRQAPGKCLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1620 - protein, 986 aa, Artificial Sequence
  Synthetic peptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1621 - protein, 986 aa, Artificial Sequence
  Synthetic peptide
EVQLLESGGGVVQPGRSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1622 - protein, 985 aa, Artificial Sequence
  Synthetic peptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1623 - protein, 985 aa, Artificial Sequence
  Synthetic peptide
EVQLLESGGGLVQPGGSLRLSCAASGFTFSSYAMSWVRQAPGKCLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1624 - protein, 986 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1625 - protein, 986 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1626 - protein, 986 aa, Artificial Sequence
  Synthetic peptide
EVQLLESGGGLVQPGGSLRLSCAASGFTFSIYAMSWVRQAPGKGLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1627 - protein, 986 aa, Artificial Sequence
  Synthetic peptide
EVQLLESGGGLVQPGGSLRLSCAASGFTFSIYAMSWVRQAPGKCLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1628 - protein, 990 aa, Artificial Sequence
  Synthetic peptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1629 - protein, 990 aa, Artificial Sequence
  Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1630 - protein, 985 aa, Artificial Sequence
  Synthetic peptide
EVQLVESGGGLVKPGGSLRLSCAASGFTFSSYSMNWVRQAPGKGLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1631 - protein, 985 aa, Artificial Sequence
  Synthetic peptide
EVQLVESGGGLVKPGGSLRLSCAASGFTFSSYSMNWVRQAPGKCLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1632 - protein, 986 aa, Artificial Sequence
  Synthetic peptide
EVQLLESGGGLVQPGGSLRLSCAASGFTFSVYAMSWVRQAPGKGLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1633 - protein, 986 aa, Artificial Sequence
  Synthetic peptide
EVQLLESGGGLVQPGGSLRLSCAASGFTFSVYAMSWVRQAPGKCLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1634 - protein, 989 aa, Artificial Sequence
  Synthetic peptide
QVQLVESGGGVVQPGRSLRLSCAASGFMFSSYGMHWVRQAPGKGLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1635 - protein, 989 aa, Artificial Sequence
  Synthetic peptide
QVQLVESGGGVVQPGRSLRLSCAASGFMFSSYGMHWVRQAPGKCLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1636 - protein, 984 aa, Artificial Sequence
  Synthetic peptide
EVQLLESGGGLVQPGGSLRLSCAASGFTFSSYAMSWVRQAPGKGLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1637 - protein, 984 aa, Artificial Sequence
  Synthetic peptide
EVQLLESGGGLVQPGGSLRLSCAASGFTFSSYAMSWVRQAPGKCLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1638 - protein, 984 aa, Artificial Sequence
  Synthetic peptide
EVQLLESGGGLVQPGGSLKLSCAASGFTFSIYAMSWVRQAPGKGLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1639 - protein, 984 aa, Artificial Sequence
  Synthetic peptide
EVQLLESGGGLVQPGGSLKLSCAASGFTFSIYAMSWVRQAPGKCLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1640 - protein, 984 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1641 - protein, 984 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1642 - protein, 984 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1643 - protein, 984 aa, Artificial Sequence; identical to SEQ ID NO: 1642
  Synthetic peptide

SEQ ID NO: 1644 - protein, 984 aa, Artificial Sequence
  Synthetic peptide
EVQLLESGGGLVQSGGSLRLSCAASGFTFSSYAMSWVRQAPGKGLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1645 - protein, 984 aa, Artificial Sequence
  Synthetic peptide
EVQLLESGGGLVQSGGSLRLSCAASGFTFSSYAMSWVRQAPGKCLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1646 - protein, 984 aa, Artificial Sequence
  Synthetic peptide
EVQLLESGGGLVQPGGSLRLSCAASGFTFSSYAMSWVRQAPGKGLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1647 - protein, 984 aa, Artificial Sequence
  Synthetic peptide
EVQLLESGGGLVQPGGSLRLSCAASGFTFSSYAMSWVRQAPGKCLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1648 - protein, 984 aa, Artificial Sequence
  Synthetic peptide
EVQLLESGGGLVQPGGSLRLSCAASGFTFSTYAMSWVRQAPGKGLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1649 - protein, 984 aa, Artificial Sequence
  Synthetic peptide
EVQLLESGGGLVQPGGSLRLSCAASGFTFSTYAMSWVRQAPGKCLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1650 - protein, 984 aa, Artificial Sequence
  Synthetic peptide
EVQLLESGGGMVQPGGSLRLSCAASGFTFSTYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1651 - protein, 984 aa, Artificial Sequence
  Synthetic peptide
EVQLLESGGGMVQPGGSLRLSCAASGFTFSTYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1652 - protein, 984 aa, Artificial Sequence
  Synthetic peptide
EVQLLESGGGLVQPGGSLRLSCAASGFTFSSYAMSWVRQAPGKGLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1653 - protein, 984 aa, Artificial Sequence
  Synthetic peptide
EVQLLESGGGLVQPGGSLRLSCAASGFTFSSYAMSWVRQAPGKCLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1654 - protein, 984 aa, Artificial Sequence
  Synthetic peptide
EVQLLESGGGLAQPGGSLRLSCAASGFTFSSYAMSWVRQAPGKGLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1655 - protein, 984 aa, Artificial Sequence
  Synthetic peptide
EVQLLESGGGLAQPGGSLRLSCAASGFTFSSYAMSWVRQAPGKCLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1656 - protein, 984 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1657 - protein, 984 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1658 - protein, 984 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1659 - protein, 984 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1660 - protein, 984 aa, Artificial Sequence
  Synthetic peptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1661 - protein, 984 aa, Artificial Sequence
  Synthetic peptide
EVQLLESGGGLVQPGGSLRLSCAASGFTFSSYAMSWVRQAPGKCLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1662 - protein, 984 aa, Artificial Sequence
  Synthetic peptide
EVQLLESGGGLVQPGGSLRLSCAASGFTFSTYAMSWVRQAPGKGLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1663 - protein, 984 aa, Artificial Sequence
  Synthetic peptide
EVQLLESGGGLVQPGGSLRLSCAASGFTFSTYAMSWVRQAPGKCLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1664 - protein, 984 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1665 - protein, 984 aa, Artificial Sequence
  Synthetic peptide
EVQLLESGGGLVQPGGSLRLSCAASGFTFSTYAMSWVRQAPGKCLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1666 - protein, 983 aa, Artificial Sequence
  Synthetic peptide
EVQLLESGGGLVQPGGSLRLSCAASGFTFSSYAMSWVRQSPGKGLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1667 - protein, 983 aa, Artificial Sequence
  Synthetic peptide
EVQLLESGGGLVQPGGSLRLSCAASGFTFSSYAMSWVRQSPGKCLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1668 - protein, 984 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1669 - protein, 984 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1670 - protein, 984 aa, Artificial Sequence
  Synthetic peptide
EVQLLESGGGLVQPGGSLRLSCAASGFTFSSYAMSWVRQAPGKGLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1671 - protein, 984 aa, Artificial Sequence
  Synthetic peptide
EVQLLESGGGLVQPGGSLRLSCAASGFTFSSYAMSWVRQAPGKCLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1672 - protein, 984 aa, Artificial Sequence
  Synthetic peptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1673 - protein, 984 aa, Artificial Sequence
  Synthetic peptide
EVQLLESGGGVVQPGRSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1674 - protein, 984 aa, Artificial Sequence
  Synthetic peptide
EVQLLESGGGVVQPGRSLRLSCAASGFTFSSYAMSWVRQAPGKGLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1675 - protein, 984 aa, Artificial Sequence
  Synthetic peptide
EVQLLESGGGVVQPGRSLRLSCAASGFTFSSYAMSWVRQAPGKCLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1676 - protein, 984 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1677 - protein, 984 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1678 - protein, 984 aa, Artificial Sequence
  Synthetic peptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1679 - protein, 984 aa, Artificial Sequence
  Synthetic peptide
EVQLLESGGGLVQPGGSLRLSCAASGFTFSTYAMSWVRQAPGKCLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1680 - protein, 984 aa, Artificial Sequence
  Synthetic peptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1681 - protein, 984 aa, Artificial Sequence
  Synthetic peptide
EVQLLESGGGVVQPGRSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1682 - protein, 983 aa, Artificial Sequence
  Synthetic peptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1683 - protein, 983 aa, Artificial Sequence
  Synthetic peptide
EVQLLESGGGLVQPGGSLRLSCAASGFTFSSYAMSWVRQAPGKCLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1684 - protein, 984 aa, Artificial Sequence
  Synthetic peptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1685 - protein, 984 aa, Artificial Sequence
  Synthetic peptide
EVQLLESGGGMVQPGGSLRLSCAASGFTFSSYAMSWVRQAPGKCLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1686 - protein, 984 aa, Artificial Sequence
  Synthetic peptide
EVQLLESGGGLVQPGGSLRLSCAASGFTFSIYAMSWVRQAPGKGLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1687 - protein, 984 aa, Artificial Sequence
  Synthetic peptide
EVQLLESGGGLVQPGGSLRLSCAASGFTFSIYAMSWVRQAPGKCLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1688 - protein, 988 aa, Artificial Sequence
  Synthetic peptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1689 - protein, 988 aa, Artificial Sequence
  Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1690 - protein, 983 aa, Artificial Sequence
  Synthetic peptide
EVQLVESGGGLVKPGGSLRLSCAASGFTFSSYSMNWVRQAPGKGLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1691 - protein, 983 aa, Artificial Sequence
  Synthetic peptide
EVQLVESGGGLVKPGGSLRLSCAASGFTFSSYSMNWVRQAPGKCLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1692 - protein, 984 aa, Artificial Sequence
  Synthetic peptide
EVQLLESGGGLVQPGGSLRLSCAASGFTFSVYAMSWVRQAPGKGLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1693 - protein, 984 aa, Artificial Sequence
  Synthetic peptide
EVQLLESGGGLVQPGGSLRLSCAASGFTFSVYAMSWVRQAPGKCLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1694 - protein, 987 aa, Artificial Sequence
  Synthetic peptide
QVQLVESGGGVVQPGRSLRLSCAASGFMFSSYGMHWVRQAPGKGLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1695 - protein, 987 aa, Artificial Sequence
  Synthetic peptide
QVQLVESGGGVVQPGRSLRLSCAASGFMFSSYGMHWVRQAPGKCLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1696 - protein, 986 aa, Artificial Sequence
  Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1697 - protein, 986 aa, Artificial Sequence
  Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1698 - protein, 986 aa, Artificial Sequence
  Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1699 - protein, 986 aa, Artificial Sequence
  Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1700 - protein, 986 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1701 - protein, 986 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1702 - protein, 986 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1703 - protein, 986 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1704 - protein, 986 aa, Artificial Sequence
  Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1705 - protein, 986 aa, Artificial Sequence
  Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1706 - protein, 986 aa, Artificial Sequence
  Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1707 - protein, 986 aa, Artificial Sequence
  Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1708 - protein, 986 aa, Artificial Sequence
  Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1709 - protein, 986 aa, Artificial Sequence
  Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1710 - protein, 986 aa, Artificial Sequence
  Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1711 - protein, 986 aa, Artificial Sequence
  Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1712 - protein, 986 aa, Artificial Sequence
  Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1713 - protein, 986 aa, Artificial Sequence
  Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1714 - protein, 986 aa, Artificial Sequence
  Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1715 - protein, 986 aa, Artificial Sequence
  Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1716 - protein, 986 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1717 - protein, 986 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1718 - protein, 986 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1719 - protein, 986 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1720 - protein, 986 aa, Artificial Sequence
  Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1721 - protein, 986 aa, Artificial Sequence
  Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1722 - protein, 986 aa, Artificial Sequence
  Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1723 - protein, 986 aa, Artificial Sequence
  Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1724 - protein, 986 aa, Artificial Sequence
  Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1725 - protein, 986 aa, Artificial Sequence
  Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1726 - protein, 985 aa, Artificial Sequence
  Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1727 - protein, 985 aa, Artificial Sequence
  Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1728 - protein, 986 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1729 - protein, 986 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1730 - protein, 986 aa, Artificial Sequence
  Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1731 - protein, 986 aa, Artificial Sequence
  Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1732 - protein, 986 aa, Artificial Sequence
  Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1733 - protein, 986 aa, Artificial Sequence
  Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1734 - protein, 986 aa, Artificial Sequence
  Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1735 - protein, 986 aa, Artificial Sequence
  Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1736 - protein, 986 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1737 - protein, 986 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1738 - protein, 986 aa, Artificial Sequence
  Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1739 - protein, 986 aa, Artificial Sequence
  Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1740 - protein, 986 aa, Artificial Sequence
  Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1741 - protein, 986 aa, Artificial Sequence
  Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1742 - protein, 985 aa, Artificial Sequence
  Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1743 - protein, 985 aa, Artificial Sequence
  Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1744 - protein, 986 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1745 - protein, 986 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1746 - protein, 986 aa, Artificial Sequence
  Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1747 - protein, 986 aa, Artificial Sequence
  Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1748 - protein, 990 aa, Artificial Sequence; identical to SEQ ID NO: 1629
  Synthetic peptide

SEQ ID NO: 1749 - protein, 990 aa, Artificial Sequence; identical to SEQ ID NO: 1628
  Synthetic peptide

SEQ ID NO: 1750 - protein, 985 aa, Artificial Sequence
  Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1751 - protein, 985 aa, Artificial Sequence
  Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1752 - protein, 986 aa, Artificial Sequence
  Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1753 - protein, 986 aa, Artificial Sequence
  Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1754 - protein, 989 aa, Artificial Sequence
  Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1755 - protein, 989 aa, Artificial Sequence
  Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1756 - protein, 988 aa, Artificial Sequence
  Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1757 - protein, 988 aa, Artificial Sequence
  Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1758 - protein, 989 aa, Artificial Sequence
  Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1759 - protein, 989 aa, Artificial Sequence
  Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1760 - protein, 986 aa, Artificial Sequence
  Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1761 - protein, 986 aa, Artificial Sequence
  Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1762 - protein, 983 aa, Artificial Sequence
  Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1763 - protein, 983 aa, Artificial Sequence
  Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1764 - protein, 989 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1765 - protein, 989 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1766 - protein, 989 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1767 - protein, 989 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1768 - protein, 985 aa, Artificial Sequence
  Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1769 - protein, 985 aa, Artificial Sequence
  Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1770 - protein, 985 aa, Artificial Sequence
  Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1771 - protein, 985 aa, Artificial Sequence
  Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1772 - protein, 984 aa, Artificial Sequence
  Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1773 - protein, 984 aa, Artificial Sequence
  Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1774 - protein, 984 aa, Artificial Sequence
  Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1775 - protein, 984 aa, Artificial Sequence
  Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1776 - protein, 984 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1777 - protein, 984 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1778 - protein, 984 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1779 - protein, 984 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1780 - protein, 984 aa, Artificial Sequence
  Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1781 - protein, 984 aa, Artificial Sequence
  Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1782 - protein, 984 aa, Artificial Sequence
  Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1783 - protein, 984 aa, Artificial Sequence
  Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1784 - protein, 984 aa, Artificial Sequence
  Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1785 - protein, 984 aa, Artificial Sequence
  Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1786 - protein, 984 aa, Artificial Sequence
  Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1787 - protein, 984 aa, Artificial Sequence
  Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1788 - protein, 984 aa, Artificial Sequence
  Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1789 - protein, 984 aa, Artificial Sequence
  Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1790 - protein, 984 aa, Artificial Sequence
  Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1791 - protein, 984 aa, Artificial Sequence
  Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1792 - protein, 984 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1793 - protein, 984 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1794 - protein, 984 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1795 - protein, 984 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1796 - protein, 984 aa, Artificial Sequence
  Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1797 - protein, 984 aa, Artificial Sequence
  Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1798 - protein, 984 aa, Artificial Sequence
  Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1799 - protein, 984 aa, Artificial Sequence
  Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1800 - protein, 984 aa, Artificial Sequence
  Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1801 - protein, 984 aa, Artificial Sequence
  Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1802 - protein, 983 aa, Artificial Sequence
  Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1803 - protein, 983 aa, Artificial Sequence
  Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1804 - protein, 984 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1805 - protein, 984 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1806 - protein, 984 aa, Artificial Sequence
  Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1807 - protein, 984 aa, Artificial Sequence
  Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1808 - protein, 984 aa, Artificial Sequence
  Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1809 - protein, 984 aa, Artificial Sequence
  Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1810 - protein, 984 aa, Artificial Sequence
  Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1811 - protein, 984 aa, Artificial Sequence
  Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1812 - protein, 984 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1813 - protein, 984 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1814 - protein, 984 aa, Artificial Sequence
  Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1815 - protein, 984 aa, Artificial Sequence
  Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1816 - protein, 984 aa, Artificial Sequence
  Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1817 - protein, 984 aa, Artificial Sequence
  Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1818 - protein, 983 aa, Artificial Sequence
  Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1819 - protein, 983 aa, Artificial Sequence
  Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1820 - protein, 984 aa, Artificial Sequence
  Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1821 - protein, 984 aa, Artificial Sequence
  Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1822 - protein, 984 aa, Artificial Sequence
  Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1823 - protein, 984 aa, Artificial Sequence
  Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1824 - protein, 988 aa, Artificial Sequence; identical to SEQ ID NO: 1689
  Synthetic peptide

SEQ ID NO: 1825 - protein, 988 aa, Artificial Sequence; identical to SEQ ID NO: 1688
  Synthetic peptide

SEQ ID NO: 1826 - protein, 983 aa, Artificial Sequence
  Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1827 - protein, 983 aa, Artificial Sequence
  Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1828 - protein, 984 aa, Artificial Sequence
  Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1829 - protein, 984 aa, Artificial Sequence
  Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1830 - protein, 987 aa, Artificial Sequence
  Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1831 - protein, 987 aa, Artificial Sequence
  Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1832 - protein, 986 aa, Artificial Sequence
  Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1833 - protein, 986 aa, Artificial Sequence
  Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1834 - protein, 987 aa, Artificial Sequence
  Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1835 - protein, 987 aa, Artificial Sequence
  Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1836 - protein, 984 aa, Artificial Sequence
  Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1837 - protein, 984 aa, Artificial Sequence
  Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1838 - protein, 981 aa, Artificial Sequence
  Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1839 - protein, 981 aa, Artificial Sequence
  Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1840 - protein, 987 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1841 - protein, 987 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1842 - protein, 987 aa, Artificial Sequence
  Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1843 - protein, 987 aa, Artificial Sequence
  Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1844 - protein, 983 aa, Artificial Sequence
  Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1845 - protein, 983 aa, Artificial Sequence
  Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1846 - protein, 983 aa, Artificial Sequence
  Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1847 - protein, 983 aa, Artificial Sequence
  Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1848 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1849 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1850 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1851 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1852 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1853 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1854 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1855 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1856 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1857 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1858 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1859 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1860 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1861 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1862 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1863 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1864 - protein, 20 aa, Artificial Sequence
  Synthetic peptide
GGGGSGGGGSGGGGSGGGGS

SEQ ID NO: 1865 - protein, 25 aa, Artificial Sequence
  Synthetic peptide
GGGGSGGGGSGGGGSGGGGSGGGGS

SEQ ID NO: 1866 - protein, 30 aa, Artificial Sequence
  Synthetic peptide
GGGGSGGGGSGGGGSGGGGSGGGGSGGGGS

SEQ ID NO: 1867 - protein, 35 aa, Artificial Sequence
  Synthetic peptide
GGGGSGGGGSGGGGSGGGGSGGGGSGGGGSGGGGS

SEQ ID NO: 1868 - protein, 40 aa, Artificial Sequence
  Synthetic peptide
GGGGSGGGGSGGGGSGGGGSGGGGSGGGGSGGGGSGGGGS

SEQ ID NO: 1869 - protein, 5 aa, Artificial Sequence
  Synthetic peptide
  MISC_FEATURE (1)..(1): Xaa is S, T or V
  MISC_FEATURE (3)..(3): Xaa is A or S
  MISC_FEATURE (5)..(5): Xaa is S or N
XYXMX

SEQ ID NO: 1870 - protein, 17 aa, Artificial Sequence
  Synthetic peptide
  misc_feature (1)..(1): Xaa is A, Y, V, L, or T
  misc_feature (4)..(4): Xaa is G or S
  misc_feature (8)..(8): Xaa is R, Y, S, G or I
  misc_feature (9)..(9): Xaa is T, I, P, or A
  misc_feature (10)..(10): Xaa is F, Y, N, Q or D
  misc_feature (11)..(11): Xaa is Y or F
  misc_feature (16)..(16): Xaa is E, K or Q
XISXSGGXXXXAESVXG

SEQ ID NO: 1871 - protein, 11 aa, Artificial Sequence
  Synthetic peptide
  MISC_FEATURE (1)..(1): Xaa is H, G or V
  MISC_FEATURE (7)..(7): Xaa is P, A, L or F
  MISC_FEATURE (8)..(8): Xaa is Y or F
XDYSNYXXFDY

SEQ ID NO: 1872 - protein, 12 aa, Artificial Sequence
  Synthetic peptide
  MISC_FEATURE (3)..(3): Xaa is S or G
  MISC_FEATURE (5)..(5): Xaa is S or G
  MISC_FEATURE (6)..(6): Xaa is I or V
  MISC_FEATURE (7)..(7): Xaa is R, S or no amino acid
  MISC_FEATURE (8)..(8): Xaa is S or G
  MISC_FEATURE (9)..(9): Xaa is S, N, T or D
  MISC_FEATURE (10)..(10): Xaa is Y or no amino acid
  MISC_FEATURE (12)..(12): Xaa is A or G
RAXQXXXXXXLX

SEQ ID NO: 1873 - protein, 7 aa, Artificial Sequence
  Synthetic peptide
  MISC_FEATURE (1)..(1): Xaa is G or A
  MISC_FEATURE (2)..(2): Xaa is A or S
  MISC_FEATURE (4)..(4): Xaa is S, T, N or I
  MISC_FEATURE (5)..(5): Xaa is R or L
  MISC_FEATURE (6)..(6): Xaa is A or Q
  MISC_FEATURE (7)..(7): Xaa is T or S
XXSXXXX

SEQ ID NO: 1874 - protein, 9 aa, Artificial Sequence
  Synthetic peptide
  MISC_FEATURE (4)..(4): Xaa is G, Y or F
  MISC_FEATURE (5)..(5): Xaa is D, S, Y, I or A
  MISC_FEATURE (6)..(6): Xaa is L, T, S or Y
  MISC_FEATURE (8)..(8): Xaa is F, L, P or I
  MISC_FEATURE (9)..(9): Xaa is T or P
QQYXXXPXX

SEQ ID NO: 1875 - protein, 5 aa, Artificial Sequence
  Synthetic peptide
  MISC_FEATURE (1)..(1): Xaa is S, T or V
XYAMS

SEQ ID NO: 1876 - protein, 17 aa, Artificial Sequence
  Synthetic peptide
  MISC_FEATURE (1)..(1): Xaa is A, V, L or T
  MISC_FEATURE (8)..(8): Xaa is R, S, or G
  MISC_FEATURE (9)..(9): Xaa is T, P or A
  MISC_FEATURE (10)..(10): Xaa is F, N, Y or Q
  MISC_FEATURE (16)..(16): Xaa is E, K, or Q
XISGSGGXXXYAESVXG

SEQ ID NO: 1877 - protein, 11 aa, Artificial Sequence
  Synthetic peptide
  MISC_FEATURE (1)..(1): Xaa is H or V
  MISC_FEATURE (7)..(7): Xaa is P, L or A
  MISC_FEATURE (8)..(8): Xaa is Y or F
XDYSNYXXFDY

SEQ ID NO: 1878 - protein, 12 aa, Artificial Sequence
  Synthetic peptide
  MISC_FEATURE (3)..(3): Xaa is S or G
  MISC_FEATURE (5)..(5): Xaa is S or G
  MISC_FEATURE (6)..(6): Xaa is I or V
  MISC_FEATURE (7)..(7): Xaa is R or S
  MISC_FEATURE (8)..(8): Xaa is S or G
  MISC_FEATURE (9)..(9): Xaa is S, T, N or D
  MISC_FEATURE (12)..(12): Xaa is A or G
RAXQXXXXXYLX

SEQ ID NO: 1879 - protein, 7 aa, Artificial Sequence
  Synthetic peptide
  MISC_FEATURE (4)..(4): Xaa is T or I
AASXLQS

SEQ ID NO: 1880 - protein, 7 aa, Artificial Sequence
  Synthetic peptide
  MISC_FEATURE (2)..(2): Xaa is A or S
  MISC_FEATURE (4)..(4): Xaa is S or N
GXSXRAT

SEQ ID NO: 1881 - protein, 9 aa, Artificial Sequence
  Synthetic peptide
  MISC_FEATURE (5)..(5): Xaa is D, Y, S or I
  MISC_FEATURE (6)..(6): Xaa is L, S or T
  MISC_FEATURE (8)..(8): Xaa is F or P
  MISC_FEATURE (9)..(9): Xaa is T or P
QQYGXXPXX

SEQ ID NO: 1882 - protein, 14 aa, Artificial Sequence
  Synthetic Peptide
GKPIPNPLLGLDST

SEQ ID NO: 1883 - protein, 5 aa, Artificial Sequence
  Synthetic Peptide
QDGNE

The invention claimed is:

1. A method of treating or ameliorating a tumor or cancer in a subject having a tumor or cancer expressing CD70 comprising administering to the subject an effective amount of a bispecific antibody construct comprising a first binding domain which binds to human CD70 on the surface of a tumor or cancer cell expressing human CD70 and a second binding domain which binds to human CD3 epsilon on the surface of a T cell-expressing human CD3 epsilon, wherein the first binding domain comprises a VH region comprising CDR-H1, CDR-H2 and CDR-H3 and a VL region comprising CDR-L1, CDR-L2 and CDR-L3, and wherein said CDR-H1, CDR-H2, CDR-H3, CDR-L1, CDR-L2 and CDR-L3 are selected from the group consisting of: SEQ: ID NOs: 1044-1049; SEQ: ID NOs: 1086-1091; SEQ: ID NOs: 1142-1147; SEQ: ID NOs: 1170-1175; SEQ: ID NOs: 1184-1189; SEQ: ID NOs: 1212-1217; SEQ: ID NOs: 1226-1231; SEQ: ID NOs: 1240-1245; SEQ: ID NOs: 1254-1259; SEQ: ID NOs: 1268-1273; SEQ: ID NOs: 1338-1343; SEQ: ID NOs: 1352-1357; SEQ: ID NOs: 1366-1371; SEQ: ID NOs: 1422-1427; and SEQ: ID NOs: 1436-1441.

2. The method of claim 1, wherein the first binding domain comprises a VH region comprising CDR-H1, CDR-H2 and CDR-H3 and a VL region comprising CDR-L1, CDR-L2 and CDR-L3, wherein said CDR-H1 comprises the amino acid sequence of SEQ ID NO: 1142;

said CDR-H2 comprises the amino acid sequence of SEQ ID NO: 1143;

said CDR-H3 comprises the amino acid sequence of SEQ ID NO: 1144;

said CDR-L1 comprises the amino acid sequence of SEQ ID NO: 1145;

said CDR-L2 comprises the amino acid sequence of SEQ ID NO: 1146; and said CDR-L3 comprises the amino acid sequence of SEQ ID NO: 1147.

3. The method of claim 2, wherein the first binding domain comprises a VH region comprising the amino acid sequence of SEQ ID NO: 1148 and a VL region comprising the amino acid sequence of SEQ ID NO: 1149.

4. The method of claim 3, wherein the first binding domain comprises a single chain variable fragment (scFv) polypeptide-comprising the amino acid sequence of SEQ ID NO: 1150.

5. The method of claim 1, wherein the first binding domain comprises a VH region and a VL region comprising the pair of amino acid sequences, respectively, selected from the group consisting of: SEQ ID NOs: 1050 and 1051, SEQ ID NOs: 1092 and 1093, SEQ ID NOs: 1148 and 1149, SEQ: ID NOs: 1176 and 1177; SEQ: ID NOs: 1190 and 1191; SEQ: ID NOs: 1218 and 1219; SEQ: ID NOs: 1232 and 1233; SEQ: ID NOs: 1246 and 1247; SEQ: ID NOs: 1260 and 1261; SEQ: ID NOs: 1274 and 1275; SEQ: ID NOs: 1344 and 145; SEQ: ID NOs: 1358 and 1359; SEQ: ID NOs: 1372 and 1373; SEQ: ID NOs: 1428 and 1429; and SEQ: ID NOs: 1442 and 1443.

6. The method of claim 5, wherein the first binding domain comprises a single chain variable fragment (scFv) polypeptide comprising an amino acid sequence selected from the group consisting of SEQ ID NO: 1052, SEQ ID NO: 1094, SEQ ID NO: 1150, SEQ ID NO: 1178, SEQ ID NO: 1192, SEQ ID NO: 1220, SEQ ID NO: 1234, SEQ ID NO: 1248; SEQ ID NO: 1262, SEQ ID NO: 1276, SEQ ID NO: 1346, SEQ ID NO: 1360, SEQ ID NO: 1374, SEQ ID NO: 1430, and SEQ ID NO: 1444.

7. The method of claim 1, wherein the second binding domain comprises an amino acid sequence selected from the group consisting of: SEQ ID NO: 835, SEQ ID NO: 844, SEQ ID NO: 853, SEQ ID NO: 862, SEQ ID NO: 871, SEQ ID NO: 880, SEQ ID NO: 889, SEQ ID NO: 898, SEQ ID NO: 907, SEQ ID NO: 916, and SEQ ID NO: 919.

8. The method of claim 4, wherein the bispecific antibody construct comprises the amino acid sequence of SEQ ID NO: 1151.

9. The method of claim 4, wherein the bispecific antibody construct comprises the amino acid sequence of SEQ ID NO: 1710.

10. The method of claim 1, wherein the first binding domain further binds to macaque CD70.

11. The method of claim 10, wherein the macaque CD70 is *Macaca fascicularis* CD70.

12. The method of claim 1, wherein the second binding domain also binds to Callithrix jacchus, Saguinus oedipus or Saimiri sciureus CD3 epsilon.

13. The method of claim 1, wherein the bispecific antibody construct is in a format of an (scFv)2, a scFv-single domain mAb, or a diabody, or an oligomer of any of the foregoing formats.

14. The method of claim 1, wherein the tumor or cancer expressing CD70 is (a) identified in a body part selected from the group consisting of: kidney, lung, pancreas, ovary, breast, colon, head, neck, stomach, rectum, thymus, and brain; or (b) a leukemia, lymphoma, melanoma, Kaposi's Sarcoma, embryonal carcinoma, renal cell carcinoma (RCC), clear cell RCC (ccRCC), papillary RCC, chromophobe RCC, sarcomatoid RCC, non-small cell lung cancer (NSCLC), lung squamous carcinoma, pancreatic adenocarcinoma, non-small cell lung cancer (NSCLC), lung squamous carcinoma, laryngeal carcinoma, pharyngeal carcinoma, nasopharyngeal carcinoma, undifferentiated carcinoma of the rhino-pharynx, lymphoepithelioma, glioblastoma, glioma, meningioma, acute lymphocytic leukemia (ALL), chronic lymphocytic leukemia (CLL), T-cell leukemia, adult T-cell leukemia, B-cell lineage cancer, B-cell lymphoma, diffuse large B cell lymphoma (DLBCL), non-Hodgkin's lymphoma (NHL), Burkitt's lymphoma, anaplastic large-cell lymphomas (ALCL), multiple myeloma, cutaneous T-cell lymphomas, nodular small cleaved-cell lymphomas, lymphocytic lymphomas, peripheral T-cell lymphomas, Lennert's lymphomas, immunoblastic lymphoma, T-cell lymphoma, entroblastic/centrocytic (cb/cc) follicular lymphoma, angioimmunoblastic lymphadenopathy (AILD)-like T cell lymphoma, HIV associated body cavity based lymphoma, Castleman's disease, or Waldenstrom's macroglobulinemia.

15. The method of claim 1, wherein the cancer is a metastatic cancer.

16. The method of claim 1, wherein the first binding domain further binds to macaque CD3 epsilon.

17. The method of claim 16, wherein the macaque CD3 epsilon is *Macaca fascicularis* CD3 epsilon.

18. The method of claim 6, wherein the bispecific antibody construct comprises an amino acid sequence selected from the group consisting of: SEQ ID NO: 1053, SEQ ID NO: 1095, SEQ ID NO: 1151, SEQ ID NO: 1179, SEQ ID NO: 1193, SEQ ID NO: 1221, SEQ ID NO: 1235, SEQ ID NO: 1249; SEQ ID NO: 1263, SEQ ID NO: 1277, SEQ ID NO: 1347, SEQ ID NO: 1361, SEQ ID NO: 1375, SEQ ID NO: 1431, and SEQ ID NO: 1445.

19. The method of claim 1, wherein the first binding domain comprises a VH region and a VL region comprising a pair of amino acid sequences, respectively, wherein each sequence of the pair of amino acid sequences comprises at least 90% sequence identity to a pair of amino acid sequences selected from the group consisting of: SEQ ID NOs: 1050 and 1051, SEQ ID NOs: 1092 and 1093, SEQ ID NOs: 1148 and 1149, SEQ: ID NOs: 1176 and 1177; SEQ: ID NOs: 1190 and 1191; SEQ: ID NOs: 1218 and 1219; SEQ: ID NOs: 1232 and 1233; SEQ: ID NOs: 1246 and 1247; SEQ: ID NOs: 1260 and 1261; SEQ: ID NOs: 1274 and 1275; SEQ: ID NOs: 1344 and 145; SEQ: ID NOs: 1358 and 1359; SEQ: ID NOs: 1372 and 1373; SEQ: ID NOs: 1428 and 1429; and SEQ: ID NOs: 1442 and 1443.

20. The method of claim 1, wherein the first binding domain comprises a single chain variable fragment (scFv) polypeptide comprising an amino acid sequence comprising at least 90% sequence identity to an amino acid sequence selected from the group consisting of SEQ ID NO: 1052, SEQ ID NO: 1094, SEQ ID NO: 1150, SEQ ID NO: 1178, SEQ ID NO: 1192, SEQ ID NO: 1220, SEQ ID NO: 1234, SEQ ID NO: 1248; SEQ ID NO: 1262, SEQ ID NO: 1276, SEQ ID NO: 1346, SEQ ID NO: 1360, SEQ ID NO: 1374, SEQ ID NO: 1430, and SEQ ID NO: 1444.

* * * * *